United States Patent 12,642,819 (COMPOSITIONS AND METHODS FOR TREATING INFLAMMATORY BOWEL DISEASE) - sequence listing, part 67

SEQ ID NO: 32 - DNA, 3829698 bp, Clostridium ramosum (residues 1,914,850-3,829,698 of 3,829,698)
  modified_base (356382)..(356480): a, c, t, g, unknown or other
  modified_base (3018349)..(3018447): a, c, t, g, unknown or other
  modified_base (3049998)..(3050096): a, c, t, g, unknown or other
  modified_base (3131966)..(3132057): a, c, t, g, unknown or other
  modified_base (3733157)..(3733255): a, c, t, g, unknown or other
cataaagatttatgtgaatgtgaaaaatgtggctatctagttatctagaaactactgttcataataaactcacaatagcatatttgttattccaagcactttgagagtttttcacatttattcacatagtaaaaaataagggtatgactttgtgcataagttgtgtgaagtttaggttaatttatgattaattagcaagattcgtcgagaaagaagtcacaaaataatgttactttttatcgaaaatcaagaaaatccttataaattaaggtttttttattcttaatagcaaaaagaaaagcacaatttaatgtgacttttgtacaatataaactattttaataaatctgaattaataaatttgtctaaaaagattttttaaaattcacattattttgtgagatttgtaaaatgttagattttcctaattatactttttcccgtaatttcattgacttaacgagctttttcatataaaatggtgaggcatatgttatttgtataaaagtataaaaaattttggaggtgtaattaatgaaaagaacatatcaaccaaataagagaaaaagatcaaaaactcatggttttagagctagaatggctactgtaggaggaagaaaagtacttgcacgtcgccgtaaaagaggaagaaaagtcttatctgcttaagaaaaatccactttacggtgggttttttttctaaaaatttatgaaaaaagaatttagagtacgaaaaaatgaagattttagccgtattattaagaaaaaacaaagtatggctaatcgttctttcattatatattacctaaaaaatgatttagatcatgctcgaattgggatatcagtaagcaaaaaacttggaaaagcagtaattcgtaacaaaattaagcgtcaagtcagaatgatgcttcaacaaacaattaatttcgatgataattatgattatatagttattattagaaataaatatttagatttagatttcaattctaatctaaatgagctaaaatatttatataaaaaaatattaaaaaggatggaaaaataaatggtgttagataacaagactaaaaaaatcttaaaagtattttgtttagttttcttagttgctatcttgacaggatgtgcacaaaatcttgatgcaaacggtaaattaattgcttctagggcaattacaagttcaactccttggtcatttgatgcagggtggtttgattttatctttgtaattcctttagctaaaggaatcttattcattaatgattatgtaggaaatgtagcttttggggtaattggggttacaattatcgttaatattatcactttacctattatgatcaaatcaaccgtctcaacgcaaaaaatgcaattattacaaccagagatggaaaagattcaacgtaagtataaagggcgtaaagatcaagcttcacaaatgcgtcaaaatgcagagattcaaaatttatataaaaagaataatgtaagtatgtttggatcatttgcaacgttccttacattaccaatcatgtttgcaatgtggcaagcagtacaaagaattgatatattatattctacatatatttttggaattaatttaggggctaagccaatcagccatattatggatttggatattgcgtatattattttattggttttagttgcaggaacacaattctttgcaatgcaaattactcaaataatggcaaaacgctcaccaaaatatcgtcctagtcaacaaatgaagtcgatgaatacaatgaacaatgtaatgacgatcttcattgtttacttagctgctacaatgcctgcagcaatgtcgttgtactggattacaacaaatgttattaatatcataagaacagtatatattcaattattccatattgagaaagcaaaaaaggaagttgaatcaacaactactaattttctaaataaaaagtaggtgaaaatatgaaaagatatacggcaagaacagttcaagatgctgtaaatacagcatgtcaagaactaggtgtaacaattgatgaattaaattatgaagtaattagtgagacaaaaactttatttactaaaaaagctgaaattgagtgttatacaattccaatgatccaagaatatattgaaagttatattcgtcgttttattggagatatgggatttgaagtggaaacagtttcttatctacaagatggtcgtatttactgtaatattaatactagtaataattctatcttaattggaaaagctggagttattctacgtgcaattaactttattgttaaaaatgccgtaagcaatacctttaagaaaagatttgaaattagcgttgatattaacggatataaagaagaccgttataaaaaagtagcatcaatggctaaacgttttggaaaacaagtattgcgcacgaaagctgaaatcaagcttgatccaatgcctgctgatgaacgtaaagtaatgcatcaagaactttctagatttgaacatattaagacagaaagtcatggtgaaggaaaaaatagacatatggttatttcatatgtagattagacacatgttatcatgtgttttttctttaaggagtgatatgaagatgaatatagaattagcaaaggcaactgatgtaaatgagatcgaagcgttatatggagcagttgtagacgatttactagccaatgtaaattatcctggctggaaaaaaggaatttatccaactcgtgatgaagcaatttttggaatagaaaaaaaagaattatatgtaatgcggcaaaatgatcaaatagtggggagtattgttattaatcatgtccaagaagaaaattatcaattagcagcttggaagatagatgcacaagatcatgaagtttatgtaattcatactttagctgttcatccacaatttaaaggattaaaaatagctcaaaaattattagaatatgctgatgaattagctaaaaataatggggtaaaaacaattcgtttagatgttcgtaaaggcaatgtgccggcaatcaagctatatgagcgttgtggttatacatatgtgggagcaataaatcttgattttaggggttctgatcttggcttatttgaattgtatgaaaaaataatttaaataatgcttgccctatagttaggtttaagtagtatgcttaacttaggaggacgacttcatggataaaatagttattaatcaagaacttttattgctacttcaaaaaaataaaataatcgccacaacgtcaaactttaattaccgggatcaagcagtcatatcactaatcaaaacattgattactatgggatataatagtagtgatatcttagaattgattgatgaagaaatgactttgctggatattctagaatttcatcaagatttggtaattaataaacaatatgaatgctgctgtttaattaataaattaaagaaaatgattgaagaagttaaggaagagaccaatggaatatacaattaaagaagtaactaaaaagtacaatctaagtgcttcaacacttagatattatgaaaaagaaggattactacctaaaataaaaaagaatcaaagcaatcaaagagtttatgatgatgatgatctatcgtggttagacataattatgtgtatgcgtaaaacgggaatgacgatagcatatataaaaaattatattgagttgtgtcaagaaggtgacaatactattaatcaacgatatgaaatttttttgaaacagaaagaaatattattattgcagcaacaagagttggaaaagaatattgagacagtgaattataaaattaatctatataaagaaaagttattaaaatagatagcaagaattattgctatctatttttctttcaattataatcaatataataagtaggtgataagatgaataaaaataaattattaatgttttttattattaatggactttttaatttagccgctaattatgctcatccaattactccaacagtaataaaaaatcttcaactgggagattatatgtttggtgttgcatttggggcaatgatgggattaaattttttattttcaccattttggggaaaattaaatgaacaaattaacagtaaaacaacgatgttgatctgtagtattggttacgcagttggtcaagttttgttttggcaagcaaattcacaaaatagtgtgatatttgcaagaatgttttcaggcgtttttacaggaggttcttatgtaagttttttaacctatgtcgttaatgttacaccacctgaaaaaaggggtcaaaatctaactgttttagcaacagttgcaagtgtttgtgctgcttttggttattttataggggggatgcttggggaaatctcaattgatttaacttttgcagttcaagcagctactttagctagctgtggtattttcttttatctttttttgtgaaaatgatgttgtttcatcagtcaaacaaaaagttgctctgctcataaaacaagcaaacccttttaattcatttaaacaagcaaaagtatttatagataaaaaatatttaattatgtttacgatctgctgccttgcatttcttggttttactgcttttgaacaaagttttaattattatatcaaagatatttataatttaacatcaggttataatggaattatcaaggctgcaattggaattatttctttagttgctaatggtacgatttgtttatggatcattaagaatactaatgtttctagatcgtcaatgctgattttattgttgagtagtgttacgatgttaggggttttagcaacaaataatataattatatttattgtgatgaatataattttctttgcattgaacgcaatcattataccagtgactcaagatttagtagctagccgttctaatgatactaatagtagtattgtaatgggattttacaacgcgataaaatcattgggtggaattataggtgccttgatggctggtttcttttatacatttaatcctcgcttaccatttatttttggttttgttgctttccttttagcaactgttttatcatactactattatcagcaaaataaattgcacaaaagttaaaacattgttataaatgttttgattttttttatttaacaagagtagaataaaattataggaaatagtaaagctaatgaatcatgatgaggctacgttttttagtataattagtattatggtaataaataagattaaaaataaataaatctggttagcttaatgcttgcacaaccagatttagcagaaattcattatttcaaagaagtgtgttagtatgtagaagtaaataactaaaactaactatattatttttgatgttttgttgaaactaaaatattttttattaatacttcattatctttagttttttcaaacatatttaataatgaatcagttgcttgttcgatcgtagtttgatctaaagattttcgaattatttgcattgcttcatattcatctttgcttaataataaatcttctcgacgagtaccggatttttgtacgtcaatcgcgggaaaaattctcttttcttgtaatttacggcttagtactagttccatatttccagtacctttaaattcttcataaaccatatcatccatccgacttcctgtttctattaaagcagtagctaagatagttagactaccaccttcacgtgtatttcttgcagctccaaataagcgtttaggaaaataaaatgatgcaggatctagaccacctgataaggtccttcctgaaggggtaacagttaaattatttgctctagttaatcgtgttaagctgtctaacaagatcattgtatcatatccttgttctgttaagcgtttagctcgttcaagggtagtttgtgcaactttgatatgactttctgatttttcatcaaaggtagagtagataacttcaacattatcagcatccaatgcttctttaatatcggttacttcttcaggtcgttcatcaataagtaagataaatatcttgatgtttggataattttttgatacagataaagcaatatcttttagtaatgtcgtttttccagcttttggtggtgcaacaataattcctcgttgaccttttccaattggagaaattaagtcaattagacgcattgataattgttcattatctttacctaaatatactctttcattaggataaatcggtgttaaaaattcaaaagcaattcttttttttgcttgatctggattttgtccgttaactaaatcaactcgcataagtgcattatatcgttcaccatttttagaattacgtgcatgaccaactatttcatcgccattttttaaattaaagcgtcttatctgtgattgggaaatgtaaatatcacgactttcttgagtataatttttaggtcttaaaaatccatagccatcaaccattatttcaagaattccagatgctaattcacccaattcgtcttcttctttggtatttaccttatttttatcattttttatactttccatagtatctccttcttattgttttattacaattaatattcattataatttagcttgctagtattatacaataaaatttattaatattcgtgattgtctttttcattatttgcaaatatcattctaaactaattaatatcgtggtatgattctatcaatgaaagattgggggattatcatggatattatggtagttattaaccaaatgattcaattatttttaattattggacttggttattttatgcaaaaaaagaaaatattaaatgatgaattaaatacgaaactaaattttattgttatttcaattactacaccagcacttattttttcatctgtttgtacaacatcgattagtgaaaagagtatggtcatttatactttagcaattgctacagcagtgtatgtgaccttaccggtcatcagttttgttttagttaaattaatgcgaattccaatgcaccaaaaaggattatacatgtttatgacaattttttctaatactggatttatggggtatccaattatgaaagccttgtttggtaatgacgcagttttttatactgctttatttaatatcctttttaatttagaagtatttactttaggcgttattttaattaattatgggaatgatgtaaaaatgaaattaaatcctaaaaatttactttcacccggagtagttgcttcaattattgcaatatttatttattttttagaaattccaattcctgatgtaattgctaattcatgtggtatggttggggacatgacaacaccattagcaatgatgatcattggggcaaccttagctaatattaaagttaaagagttgttcacagaattaagattatactactttacgattgttaaacaagttattttaccaattgctgtttttccaatcattgcatattttatcaaagatccattgattcaaggaattactttggttaatttggcaatgccggtcgctaatagtgcagttctttttgctaaagaatatggtggagatgttgaattagcagcaaaaagtatctttattactactctggtcagtgtctttacaattccgttaatagtttcattattgcttgtttagtatacttttatattattaagtaaagaacctcgtgaatataacgaggttctttactattttgattacagaaaatatgtgattaggggatattaattttgggagaggtcaatatccccacttagattatatcaaaccaaaatagtgttatcaaataaaaaaagaccaaaatggtctaaaaattaaatttttacttatgaataaagttattttttgaaatatattataattatttgaaaaaaataacatttaatgtcacaaataacaagttagggctttcattcccaaacaaggccaaagtattgtttaaataaatgtgttatgagatagtaaatatgtacttgataggccgtcaaagtaaagcagaaaaagtagaaagagagataaacaaaaatgaaaaaatatagtgtttgtattgttggaggaggaagtacctttacattaggttttttaaaatcattctgtcgtatgaaagaacagttcccattaaaaaaattagttttatttgatattgatgcagagcgccaagaaccaattggtgaatttggaaaaattttattcaaagaacaatttcctgaattagatttctcatatacaactgatattaaagaagcatatgaaggaatggattttgtgtttatgcaaatgcgtgcagggggattaccaatgcgtgctaaagatgaacatattcctttaagcatgggattaattggacaagaaacatgtggagcaggaggaatggcttatggacttagatcatgtgttgatatgatcaaagcagttcatgatattcgtaattatgcacctgaagcttggatcttaaattattcaaatccagctgctattgtagctgaagcattaagaagagaatttcctgatgataagaaaattttaaatatttgtgatcaaccagaaaatgttgttcgttcatgcagtcgtttattaggttgtgattgggaaaatttagatcctgtatattttggtttaaatcattatggctggtttactaatatatacgatattaaaacaggggaagatttattaccaaaattgagagaattaattaagaaaaatggcttcttaccacaagatgcggaacaaagagatcaatcttggttggatacttatggtatggttgaaactttaatgaatgattttccagattttttaccaaacacatatgatcaatattatttatatccagattataaagcagcacatttagatcctaattttactagagctgacgaagtaatggcaggacgtgaaaaacgagtttttgatgaatgtcgtgaagttatagctgcgggtgttttaggtgataaattcgatgatattagtgatgcccatgcagaaatgatgatcaatgtagctgaagcaatcgcatataataaaaatactcgtcatattttaattgttgaaaacaatggagcaatcgctaatatgcaggatgatgctatggttgaagtcgtttgtgaattaggaattaatggaccaagaccaatgcgtgtaggtaatattccacaattttatttaggattgttagtaaaccaagtttcttgtgaaaaattaattgttgatgcttattttgaaaattcatatcaaaaagcattaatggcatttactttaaatcgtttaatcaatgatggtaaaaaagctcgtaaagtattagatgctttaattgaggctaataaaggaatgtggccagaattaaaataaaataataaaaggggattagtatgaaaaaaaataaagtaatggatttcttctcggctttaggaagaagtttaatgatgccaattgcggctttagcagcatgtggaattattctgggagttactgcagctttacttaaaacacaagtagtagaggcagtaccatttctacaacagccagttgtattttatatcttaaatacactaaaaacagtatcaaatgttgtttttaccttaataccagtattatttgctatttctatttcatttgggatggctaaagaagataaagaagttgcagcatttgctggatttattggctattatactttcttagtaagtgcaagttgtatgatcaattctggttttatgaattttgattcattacaaatttcaactattttaggcgtagaaactttagatatgggagcagtagctggtattttaacgggggtgaccgtagcggctttgcataataaatatcataaagtagtattcccagtagcaattgctttttatggtggtaaacgttttgttgcaattatcgttatcttagcaatggcgttattaggacaagtagcaccatttatttgggcacctgtatcagctggaattaatggtttgggtacattgatttctgaatcaggtttattaggggtattctcatttggatttttagaaagattattaattccaacaggattacatcatgttttaaatggtatttttagaactactgcaatcggtggggtatatcaaggggtagaaggatgtttaaatattttcttgcaattctttgatagtgttgatattagtgtaatgcgtgaatatacacagtttttgggacaaggaaaaatgttgtttatgatctttggattacctgcagcagcctatgctatttataagacaagtccaggtgaaaaaaagaataaagttaaagcattaatgattgcaggagttgcagcaagtattgtttctggaattactgaaccattagaatttgcatttatgtttattgcaccgccattattcttattccatgcggttatgggtggtatctcctttatgttaatgtcattattacaagtagcagttggaaatactggtggcggtattattgatatgtttatctggggtgtcttccaaccaggatctaattggtattggataattattattggtccaatctatgcaattatctattataatgtatttaaatggtattttaaccgcaaacatttatcaattgaagttgcggaagatgatggagacaaggatactaatgatactgcgagtattagtgataaacaacaagcgctagcaacaaaaataattgaaggcttaggaggatttgataatattattactgttaacaattgtatttctcgtttaagagttgatgtaaaagatatgtcattagtaaatgaagaagaacttaagaagacaggaagtatgggaattgttaaaccatcagaaactcatattcaagtaatttatggtcctaaagtagaacaagtagctaattcagttagagaagttttaaaatactaattaaaaaggcaacgaatttaatcagttgccttttctaaagctaatttttgagcagttagttcaataattatttgcataattgtaaagatacctagccttgaatttatgtctacgccatgataagttagattttcatcattactacttaaaacataatcacaagaatctactaatgaacctttagcgttagatgtaagtaaaataattttacagtcatgggtcttagcaatcgtaactacttcatcatatatctttccagcattgtttgctgatacaataaaaattgtagcaggagcctttaaattattaaagacactttttgatagatgaagatcattgattaaaatacaattaatatcaatagatgataaaatagtttgaaaataatcagcagccactaagcttaaactcctacctacgacatagatcggttgaggactacacaataaatcaacaacttcttcaataatttcataatttaagtttttaagattatcaagaaaacgggataagggtttttcaattatcatttgataatcaatttcttgatgcatactttgctttaattcatattttagttcattaaaaccagataagcctagcttattacaaaagcgcatgattgaagcattagacatatacgttgcttttgctaactgtgataatgtcattgatacaacttccttacaactattttcaagataatatagtaactctttttcattttcagacaaatctaaagatttagcattttcaagtaaagcaatcattattccttttcctttctaactaaataagttttaaatattacatcaataatatagaaaattgctaatcttgaagtatattcagtatcaatattttcacgatgattaacaaaaaaacgaaaattaatatttgctaaatcagcaatagcattcttagtatatggactaattgctataattgttgcatgatttaaattaaataatttaacaatcttaaccgtagtgggataattaccactagtacttatagcgattaatatatcatcttcattggcattactagcaatatgtgctgctaaacgagatgatttatacttgtagacattttgacgaccaattgaaaataacaatttttcaagatagtcgacagggattcgggaaataccttcaccatatagatggattcttttattactatcaatcaaatcgatgatttcttttaaataacgctctttgattaataatgaagtgctctcaatatcatcatatagactagtaatagaatccattgaagaaattggtttctttaaattcgcaatttctttattttgctgttttaatgcaaacttaaattcagcaaaaccactaaaattaagtttcttacaaaaacgaagaatcgtagcagaagaaaaggcaacagctttagctaattcttgaatactcatgtcaataacctcatcaggatgatcataaacataatgaagaatatataattcactttgacttagatttttaattatttcatcatctagttgatttattaacataagtttcctcttttctttcatatagtaaaataattatacaataaaggagtaaaaaaatgggattatttaaaaaaaaagataaatatttaaaagccttcaccagtggtaagatcattccaattacagaagtaccagatgaagtatttgcacaaaaaatgatgggcgatggaattgcaatctacccggataataatataatcgttgcaccatgtgatggtaaaatcacagctattatggaaaatacagaacatgcagttggaatcacattagcaaacggtgtagaattattaattcatgttggtctagatactgttaatctaacagaaaagattttttcagtaaaagtagctaaagaaagctatgtacatacaggtgaagaattaattacttttgataaagtaagactaaaagaattagggtatcaagatattacaatgttagtaattttagatacgggtaatactaagaaactagaaatactatcagaaacggaagcaattataaatcaaacaaatatcattaaatatatagattaaatattttattgaaaacaataaaaaataataataaatatagataatatccaagggtaatgatatactatgtactagcgaatcctgttggattttatcgaaaataaaatgaaacaactgaaatgaaaaaataatatttgaagagggagatcatgctaactgcattaatttatagcatagctctcttttttatgttatcaagatataaaattaggttgtgataaaaaaagttagaccaatctttagataaatttaattttgtagataaaatcagtgtatattgaagttgataagtaaagaaagatatacaagtttgcaggattttgttatagttagccagtgataggagtagtttaaatggagataaatattgcaatttgtgatgatgacaaaaattacataaacgaaataattcagtatttaaataattgtagttggaaaagaaataatagttttgtatatcatactttttattgtggagaggcattattagaaagtaagcaatattttgattttataattttagatattgaaatggataaagtttcaggtatagaggtaaaagaaatattttataatcgaaataatcaatcaagaattatttttctaaccaactatgaggaatatatgagtgattcatttgggaagaatgtctatggatatatcagtaaagatgttcttcataagatggatatcccgcttaataaaatatttaaagaacttttagaacatcgcttaattaaaataagcgaagatataattgatttatatgaagtatattatgtaaaagccgatggaccatatattaatattcatacaaatggcagttatgaagtttatcgcatgacacttaaagattttgctaataaaatacataattcaaattttattagaattcataaatcttatttaataaatatgaggtatattaacgaaataaataataagtttttaattttggataatgatgaaagattaccgatatcaaagagtaaccgtaaaacagtattaattacttatagaaaatatttattggagaatataatttatgactagctggataattttattaattaaacagtatattgatatagctaaatatttattaattagtgatgctatatttgatttaaataatgataagaaaaagagaactaaagaaaatatcatattatctagtataattttagtaatctatataatattttatagtaaaatagaggatatatggatagatttaaatgcactgatatgtttaatctatctaattattatttatagagataaattatttaaaacatttaaagtagttataattactattttaattacaacaatgttagagcaatttggtgcactttttataaaaagtgatataactaaatttaacacaattgaatttataatttcaaatatttttagattagttttaataatgtttatagccttgcttataaaaggaacaaaaataaattctagaggtaaatatagtttggaaaatattccatggtatatctatatgaatataatttttggctttagttcaacgttatttccattattagtagttcaaacatatcatcttgatataaagtctgttttgtctgtagtaataacaatagttgcatatattaatatcattgtatcattgatttctgtttggttatttttgagaaataagaatgaaaaagaaaagtattatttggataatattttgaaagataaaactttaaaattgcaagaagattattataaaaaaattattgataattattctaatattcgtaaatttaaacatgatattaaaggacatttggcagttgtaaatgaattaataaattcaaaaaattataatgaagtaaatgtttatatgggaaatatgtcggaagcaataactggtaaagatatttataacactaataatatctacatctctagtattttaaactcttttgatcagtcatttattgataataagattgagttcgatctgtcttattatattattggtgatttaaagatgagtagtatggatatttgctcattattttataacttaattttaaatgcagtagaggcaaatttaaaaataaaagataaacgttttattaaattgtacattgcaaatataaaaaataacgtggttattaaaattattaatccagttaatgattgctttaatttaaatataatagaagaaagaaggacatcaaaagaagataaagaaaatcatggttttggattaatcactattaataatattatttctaaatataatggaaatatcgaatatagtatcgacaataaaatgctaatagttgatattactttacttagtattttggatgtatagtatcgtttaatacaaaaaatatctatataatacaataaatgttaaattacattttttatcgttattatttcctcaaaaggaggaaatatgcatggtagtatatagtatttttgactggatagaaaaaatttttggtggaggaaaataattaatatagtaccaattttaatttaatttatttaaaagataacgtctcttgtggggagggaagtttatcaaatattgtcagggcactttgacagacacataatataataaaaactacgggttatatttccgtagttttttcttattctataggaatttggattcgtctgataataacagtatatcattccaactaaaagggtacctgatttatggtacccaataaaacaaaaaaaggtgataatcatctgtagtgattaatcaccccgtggacaaaatttattttgtcccttttttatctattttgcagcagtgtcataagcatcttgtacatatgcaacaaaatcatcaagcgttaaatcaaccttatttaagatctgctcaactgttttaacaacatctttattgatctcctgtttggtgttttctgaggcataaacaaaaccaacaattgaatcaccataatcacttttgtcattaggaacatataaataggctattgaatcaactttatcatctagaaaatatgtaatgatttgtgattgtcctttatcttcctcctttattaaagctagagcattataagtagtatcctctttaatttcctgattatagccgatatctttaaaggcattggtaatagtactgatgtcttttttgtcgctagaaccactatcactaccgccacaaccaacgatactgaaacatagtaatgctgttaatactagttttcctatttttttcatatttgatattcctttccttttgtagagtataacgtatatccttggatattgctagggcgatgcttagttttaacgatattaaatatttgaatttattcttattttcttattcgatattttagcgtataataaagcagaaacttatagaaaaatattttataaaagtcattataataaaccgttaatgataagctaggcaaggctcttaaattttgtcattttgagtaggtgacaaacttcattttcattaaattgaaaacgctttaaggggcttgtatagtaagggttgtaaagagaacaaatgaaaggaaagagcaaacaatgaaagaaaaattatagaaatttggacgagcattaagcgcgatggttatgcccaacattgccgtgtttattgcttggggattaatcacatcattctttattgctgatgggtggtttcctaatgaaactctagcaactcttgttgatccaatgaacaagtatttgttaccgatcttgattgggtatactggtggtcataatgtttatggtcaacgtggggccacggttggagctattatgacaattggcgttctggttggagcaccgattccgatgtttattggagccatggtcgctgggcctctaggagcttggttgatcaaaaaactagatgagttattaaaagatcgcactcctcaaggatttgagatgttagtcaataacttctcagcggggatcttaggttttattctggcaatcatcggttgtctagcaattaaccccgcttgtctagtcttaaacgatgttttagtaactggtgttaatttctttgtgaaaaatggattattgccactagtatcaattatcgtagaaccagcaaaagttttatttttaaacaatgctatcaatcatggtattttctcaccaattgggatgcaggaagttctagaatcaggaaagtcgattttcttcttgattgaagccaatccaggtcctgggttaggaatcttgttggcatactgtttttttggtaaaggcggtgctaaagcatcagcacccggagcggcatttattcattttgtcggggaaattcatgaaatttatttcccttatatcttaatgaatccggctttgattctagctgctattgctggaggggcatcaggcgttttagttaatgtgatctttaattcaggattagtttcaccagcatccccaggcagtatcattgctattctaggaatgtgtaaaggcgatagttacttaggggtaatcttaagtgttattgttgccaccgccgtttcctggtttattgcatcgatcatcttaaaaagaagtaagactgatgttggggatcttgaagaagcaaagagccaagtaagtgaaataaaagcagcgggaaaacaaataccgtataatcaattacgaaaaatcgtctttgcctgtgatgccggaatggggtctagtgcgatgggagcagcgttacttactaaaaaattaaaagctgctggtattgaaatcgacgtaccacattatgcaatcaatgatattcctaaagatactgaggtagttgttactcacgaatcattagtagagcgcgttagaggcgatttaccagaagttgtaatttttcctatcactaactttatgggtggtagcgaatatgatgaaatcgtaaataaattaaaataaatggaggtaagaaggatgtattcatcacgagaagcaataatattatcaatttgtttgttgagggatgattatatcacttaccaagaaatatccgaagaattaaatcttagtccccgtacaattatgcgggagctagcacaattaaaacactctttacaaaccatgaatttacaaatcctttcaaaaaagggaaaggggattttaattaccggatcaaatgaagctaaacaaaatttaattatggatatccaaggatcaaaaattgaatacatggataaagaagaacgccaagaattactttgtttagaattactgcggactaatgatattcaaaaactatattattacagtaataagtttcaagtatccgaagcaaccatttctcatgatcttgatgatttagaagaattctttaaaggttttgatattaaagtgattagaagaccagggtatggaatcaatttagaagccgatgagtcaacgattcgccaggctatttcaacaattattaataataccgtgcaacatcatattatgaatgttgattttgatcgctataacattcaagatgtaattgaccaaattatcgtgaccaagaattctagtatgaataaattattagatcatgacgtattaaaaacaatcttagaagtctttaaaaatcatcatcaagaacttaatttagataatatggctaaaagctcatatatgggcttattgatccacttaatgatcgcaatcaatcggatcaaagaaggagaacagctccaagataatcaagccatctttagtctaattagtgatcgtcaagcataccaaaatgcgcaaatgatggtagcttatttagcccaagctttcaatatcaatattgaagagacagaatgtgcttttgtcgctattcatctgcaaagtgctaaatccgcgatcattcaggaaaatgaaaaccaagttgaacaatatcatgatctcattatggccatgttaaatgtctttaatgatcatcagattaatttatatagtgattatgaattataccaaagcattgcagctcacttagagccggcaatggtacgtttggaatacgggttaccaatctataatccgatgttaaaacaaatcaaagaaaattatcaagaaatatatcaaataacagcaaaagctagtcaagttattaatgatgcctatgggtatcagttaaatgacgatgaaatcggctatttagtattacactttgccgctgccatcgaacgtcataaactaaacgaagataaacgcttaattaatgtaggaattgtttgtagtagcggtattggtatctccgccttattgatggctcgattaaaacgaatcgttgatcgtaatgtcaattttgtcccattatcgatcagtgatgtaaataatcataactgtgagttactaatctcgatctttgccgttgaaaatgccataattgtcagtcccttattaaatcaaaatgatgttgttaatgtagtccaggctatcgaaactacccgtaaacaaaaggcgctatcgaagtcgtttaaacatacctcagttgatctaatcgaagttttagatatcgttaaacatattatcgataacttgtcactaacagcaatcactcatcatgccagcaaagacgaggtcattacagcgttatgccatcaagtaaataatgatgaaatgctaattaaccaaatcaaagagcgggaacataaaggcagcaatgtctataattcattcggttttgccctgttgcacagtactacaaatgcagtcaaacaatgcttagtaaaagttttaaaaccaaatcaagatacatttacaagtgttgatttgatcggtattaaaattgtgttactgatgttaatacccgaaaaatcatcagcgttgcaaaaacgaatcatgtcgcatctttccgccatgttaatcgaagatgataatttcttaattgatctagctaattgtaacgaaactaatctagctaatattttcaatgatattttacaacaatttataatcaatataatcaaagaggaggaataacaaatgtcgagaatcaacgtatattttgtctgtgatgccggaatgggatccagcgctctaggtgccagtctactaaaaaaatttgtttccattgatgtaaaagtctctaactgtgcaatatacgagattccctatgactgtaatgtagttgttggccaaagaggcctaattaaatccctcaaagagcaatttcggtttttgaaaatatatgcaatcgattactttcttgatgaacaaagactccaacaaatagcaaaggagataaatgcaatgattgataataccagtattttagccaaagaagccattgttttaaactgtaaggcttcatcaagcgatgaagcaattgtggcagttggtaaattattacaagataaaggctatatagaagcgccttatattcaaggaatgttaaaccgggatcatgatttaacaacctatattggcaatgatctagcgattcctcatggggaatatgacgtgaaagattatgttaaaaaaaccggaattgcggtaatgatctatcctgaaggaattaactgggccggaaaccaggctcgaattgttatcggaatagccgccaaagataatgatcatatggagattttaactaatatcgctttaaagttaagtgatatggatacggttgaacaattaatttcttgcaatgatattaattatatttatgatgtcttaactcaaggagaataaccaatgataataactgtaaccctaaatccagcaattgataaaacagctcaagttgaaaagctgactattaatggattaaatcgcttaaataatattattcttgatgttggcggcaaagggatcaatgtatctaaagccattaaagaattaggtggtaagtcgatttgtactggttttgttgctggcagcaatggtaagtggatcgaagaaaaattagatagtctaaatttagactatcgattccgccatgttgaaggtaatacgcgaattaacttaaaagtattagataaagagatgaatttaacggaattaaacgatataggtgatcaaattgaagaatacgagctaactcgattaaaagaaggtttattagaaatggtcaatccaggtgatatcgttgttttagcaggtagtgtacctgcgggtgtgccagtaaccatttatcaagaattaattactttgcttaaagaaaagcaggctaaggttattatggatgctgatggtgaattgtttactagtggaattgaagcgggaccgactttgatcaaaccgaataaatatgagttatgtaaatattttggtttagctgaagatgtaagtgatgttgaattagtaagtcacgctaaaaaactattatataaaaatattgaaactgtcgtaatctctttaggatctaaaggagcaatcttcattactaatgaagaaactgcttatgtaccgggtctagatattattgcccattcagccgttggtgctggagattcgatggttggtgctttagcttatggaatcagtgaaggtttggagctgatccctttgatcaaacttgctgtagcgacatcagctggagcagtaatgaccaaaggaacgaaagcccctaatcgaagtgttgtagaaatgttgatgaaagaagtcaaaattgattttagatagaggagaaataatcatgaaaacaaaagcaatacgcttatatggcgttgatgatgttagattagaagaatttgaattaccagaaattaaagatgatgaaattttagttaaagtagtatctgatagtatttgtatgtcaacttataaaacaatcaagcaaggagctaatcataaacgagttcctaatgatgtttatgataatccaattattattggtcatgaatttgctggagatattgttaaggttggtaaaaaatggcaagataaattccagccgggtcaaaaatttgctcaacagccggctattccaggacaaatggaatcaccaggttattcatatcaatggtgtggtggtgacagtcaatactgtattttccctaatgatattatagaagctgattgtctatggacttttgaaggtgacagttactttgctgcctcggtagctgagccaatgtgctgtgttatttccggcttccatactcatttccataccgttcctggttgctatgaccatgtaatgggaactaaagaaggcggcgatatcttgattctaggcggctgtggtccaatgggactaggtgccataagctatgcgttaacttatgaaaataaacctaaacgagtagtcgttacagaaatctctgatgaacggattgctcgagctaaagaagtgatttcagttgctgaagcagctgctcatggggtagaattgcattatgtaaatacggccagcatggaaaatcaaaaagaggaattaatggcattaactgagggtaaaggttatgatgatgtctttgtttatattcctaataaagaagtagctgctttgggtgatcagttattagcttatgatggtaacttgaacctgtttgctggaccaactgatcctaatttctcggctgaaatcaatttatatgattgtcattattcaagaactcgagtgcttggtagtaccggtggaacgattgatgatatgaaagaagctattgacaaagatgctcaaggattaattaataccgctgtaatgattactcatattggtggattagatgccgttgttgatacgactaaaaatcttcctaatatccctggcggtaaaaagttgatctatacgcatattgatatgcctttaacggcgattgctgattttgaagaattaggtaatacaaatgatttatttaaacaactagctgttgcaaccaagaaaactaagggattatggaatagtgaagctgaaaaaatcttattaaactattataaataatcaatcaataggcttatatcaatagatgtaagtctattttaataaaaggagatgttatgagaagtgttaatgaaagatatttgtcttccttagctaaagaatatccatctattcaagcagtttgttgtcaaatcgttaatctaaaagcaatgttgaatctgcctaagggaaccgaacactatatatccgatgtccatggggaatataagttgttcaaacatttaatgaataattgttcaggtgtcattaaagaaaaggtaaatctgttatttaaagatgagatttcaatagaaagtattaacgaattatgttacttgatctattatcctcgaaaactattaatgtcaaaacaatttgatcaagagtggtacaaagaaactatcttaaggctgattcgtttagctcgttatattacttctaaatacactcgtaataatgttcgacaaaatattaataatgaatattcagaaattattgatgaattacttcatgcccagctagatgaaatggatcagcagtatgtttatcacttacatattattgaatcgatcattgaactaaatgaacaagattattttattgatagtctaagtaaaatcattaaacatttcgcagttgatcaattacatattcttggtgatatatttgatcggggcaaagagccagataaaataattgatgatttgattaaatataagcaagtagatattcagtggggtaatcatgatgtattgtggatgggtggctatcttggtaatttagcttgtattatgacgatagtaaagaactgtattaaatatcaaaatattgatttattggaaaaaagctatgggattcctttaagagtcctaatgatgcaggctgttcgaaaatatccagagtgcaattatttagaagcgatggatcaactagtaatgaaaatattagttaaattagaaactagattaattacgacttatcctcagtggcaaatggattatcggattgtcaatcccgactttaaagagttgactaaaagcgaacagttgattcttgatgatttgaaaaaaagtttcgcaagcagcaaacggcataaaaagcatattgaatttatttatcaacacggttctttatacttaaagactaatcataatcttttactccatgggtgtgtccctttagatgaagctggtaacttttatgtctatgaacattttggtcaaaaactatcaggaagagcttattttgatgttgttaatcaaaggattaaccaagcctttaaacaaccaaatcaggagataattgattatttttggtatttatggtgtggtcaaaaatcaccattatgcggtcgtaaaattgtcttagatcaaaaacaagaagaaattcaagatccatattatcattatataaattttgaggctacctgcttaaagattcttgatgagtttaatttacacgatcctgttagaatgatcatcaacggccatactccagtacgggttaaagacggtgaaactccattaaaaggaaataaccgctgtgttgttattgatggtggtttttgtcttcagtatcaaggtaaaactggtgttgcaggatatacattaatttctaatagtcatggaatgcgcttaaaaacacatttgatcaatgatgaatatacttttaatgttgataacgatatggaatataactctaaaattatttatactcggaaagtccaagagttgatcaaggatactaaacgtggtgaaatgttaattgaacaaattaatgatcttaataaattattaactatctatcgaatcaaggcaaaggagtaaaattctttgcttttcttttatttgatattcaattaaaatattaactaagggagcgtgagtttatggatgaagattttatttatcaagttttagcgattgtttcagaaataccatcaggtaaagtagccagttataaacaaattgctattttagctggcagagaaaagaatgctcgattggtcggtaaaatattaagtcatgcttcaatgtatggagagtatccttgccaccgagttgttaatagcgctggtcgcctagtacctgactggatcaatcagcgagaattgttattacaagaaggagtgggttttaaagtaaacggtaatgttgatatgaaaaagtatcggtggcaaaattaatagtcaaatagtatcttccagcaatattctaagggatagttagtccatataagcctatataattatggctaaataaactatgattatatagtataatctcgttttcgacacttgttggagagcaaaaaggcggaacccccttgatatataaggtttttccgcctcttttgttgtttgtaaaaatgttgtatgggaatattaattataaaatttttttaattttttttcgcaactccttgggctgataatattccttgttgagttccaatccaaatacatcatttaatgcatcacatatttcactcccactatatgttgcctgataatagaggtcatgattattaactacattcatattttttgtgttctctattatttcttctattgtaaagtgataatgatgttgttttaatttttcctccatcaatctatatatcaataatgcagtatagcacaccatgaaatgaccaatgattctatctttttttctatgattgactggtctggccttgaaatatgttttgagtactctaaaacagtcttctatcttatatctttgagaattgacttcaaatatgtcttttgcttcttttggtgcatccagatttgtggcaattgcataaaatccatcatacttctcttcttcttttatcagctcttcattgatgacatatgtgcctttttgatttttttctttcatgatgaatctctttggatcgttctgattctttttcaaatcttccactttattatatttgataagtttcttggctctctctatctgattgtttctgatttttcgttgatattccatcatctttctggaaaatgtaatgatgacatattgatttaaagtaccctttgccttccttttttgggtctttccgtttttgaatgtcatttcttcttcaagtcccaaatcaaccagcttatctgctgatataactttataagcatgatcttcatataaatggagattttttttatcatgtctatcaaaagttttgagtttatctatagttatagcttcatcgttggataataatttataatcaaagtcattaaatacagcttcttttaaagtatgagatagtttctttattgactgagtgactataaaagctcgacttccaaaagaattgaattttctgatattaagagagccaagtccaacatcggcacaatatatcaattttttatcggtgaatgttttaatcattttttcctcagtagctgtagcacatagctgctcattctgattgcctggattgatacacattgatattggaataccagaaccatccataaacaatcccatctgtacaagtggcgcaggctggtactgctttgacagaccgtattttcttaggccgcttgaaataagctcacctgttacatcatcataatcatcatcgtctggttcttcgatttcaaaataatagttggtgcagtcaaaataacagacagatgtgtttcttttgacgatattatgactgtttgtgaaaaggatgctgatatattcatcaaaatgatcagctaaaatggaatgatgttttagaatgttatgatattgaatgtcaggtgcttcaaaatatgtatcaagatgtctgaaagttcctaacttggaacgaggttcaaggatcctatcgaaggtaacaaatcgattgatttcgtttaaatcataggtgatcctggtgtgagaagcaatttcatcaagaagttccttgatttttaagtctttatagattttttgaaaatatagataaccaatatttatatttaatgattttgaaactttatttgatgctggagagagtttcttatcaaaatctatagagatatcaatcttgatcttattatttttaatttcttcattataagatttaaccatatccttggcatattgaagagggtcatcagtaattttaagaagatcattatgtttaccaataacttttatgtttctagtggtagtttttttaccattgcgaataccctgttggataaaataagtaggatttttagattttctatcatagttaagtttcaaggcaaagcacctcctgatacaatcatatcataaaatacaacaccatacaacaaaaacaaaacaaaaatttgacaaaaaaataacgctataatcagcgttatttgaattattggattgataaagtgtcgaaaacccgggctaaataaactatgattatatagtataatattgttggaggggtatgaaagatggaaaaagaactagacaagatcgttaaggagttaaatagaacaattgaaaatttaaagtgggataagaaggttactgatgctctaatagaattacaaaagattaaacaagagctagatcgaatgaagaatgaaatagagcaaaaaagctagagtaagtgagtataatattataggtaattttaaaaatttgaatatgctaaaaattcaaaattagttcttaatgcattagacagaaagtagaaataaatagaagcgataaatgataatgttgttaaaaagataatcaaagtcatgaaaaaactagattgttatgatctggtttttttgctttgaaaattaatttaaaatggtttagataagtaataaattgttatagcatgtatggttaaattatgagcaatactgaaaatatcaaattaaaataaatatgttgcaagatgtattaagtaaagggataatctctgaggatattatattgataaaaaattaatgtagtttttttgttggtaaaagtgaaaacaacttagatgatttggaaagctgattggtcttaaaaacattgaaaaaggatatacctcacgacatcatttaatttatgtttagtgttccagactgatataaaggagcaataaccaggcacgtctaaaatccccaaattcagaagtagttttgtttaacagaggggatgcgttatattataaataaagttggagaaaaaaatgaaatttattatataaaagaagcgatattgtcaataacagaagaaaaagtaaaagctttcctttgagtggaggaagctcatcgtattggaccatcattttggataaatccttggcgtatgtagtgtaatttatattgaaatacaggtattgatagacggctagcgattacctaaaatgaaaaattgctttaagatgtactaaataagtaacaaatcacgtgaatcctgcatcctaagatgaagatattttcttgtcgtgaaaatatctacaaaatatctacaaattttcaattatttattgtataatggggcaaatgaggtgattccatgaatacagtttcagtcgaaaaaaatgccattgaagaagtcgctaagttagttagcgatagtcgagttgtggcttttccaactgagactgtttttgggttaggagttaagtttggctcacatcaggcattggatgcactatatgaattaaagcaccgcgataaaggaaaagcaatttctatgatgattagtaaggcagaggatattgaaaaatatgcttatgttgatgaaactgcaaaaaaacttattgcggcttttatgccgggaatgatcactatcattttaaagaaacgcccacatattgatgattattttacggcttcactagatactattggaatcaggataccagatgatccatttgttttatcattattagataaaacaggaccaatgttagtaactagcgccaatctttctggagaaaatagtcttgttgacgacaaagcagtaatgaaagtatttcatggaaagattcctttaattgttaaaggtgaaagcatcagtaagaaggcaagtacaattgttgacttaagtaagggtaaagtggaaatattaagattaggtgatatttctaaggaacaaatagcggaggtaattgaatgaaaattgcaatggcttgtgaccatggtggcttaagactaaaaaatgttttaaaagattatttagaagctaatggttacatagtagaagatttcggaacatacagcgaagatagttgtgattatcctgattatgcaggaaaagcagctaaagcggttgctagtggatcgtgcgatagaggggttgtcgtatgtggaactggtatcggtgtaagtattactgctaataaagtgaaaggaattcgctgtgcgttatgccacgatgtatttagcgccaaagcaactcgagcacataatgatactaacatgattgctatggggcaacgagttattggtgaaggtttagctttagaaattttaacagcctggttagaaggcgaatatgaaggtggtcgacatgaccagcgaattgcaaaaatgatggcttacgagggggaagagtaaaatgaaagacatcgcagtatttgaaagtgtagagagagaattaaatcgtcaaagaaacaatattgagttaattgcttctgaaaactttgtttcaccagaaatcttagaattggcaggaactgtattaactaataaatatgcagaaggttatccaggaaaaagatattatggtggatgtaaatttgttgatgaagtggaaacactagctaaagaaagactatgtaagatttatggtgctgagtatgctaatgttcagcctcatagtggagcgcaagcaaacacagcggtatatatggcgttattaaatcatggtgataaggtattaggaatgtctcttgctgatggtggacatttaacacatggacatccattaaattattcaggaatcaattatgaattccacagttacggggtaactaaagaaactgaaactattgattatgaagattttaagaaaaaatgccaagaggtcaaaccaaaattagtagtagctggtgctagtgcatattctagaacgattgattttgaatacatggcaaaatgcgcgcatgaagttggggcgatgtttatggttgatatggcacatatcgcagggttagtggcagcgggactgcatccatcaccatttcctcatgctgatattgtaacaacaacgactcacaaaactttacgtggacctcgtggtggggtaattatgtgtaaggaaaaatatgcagctgatattgatcgtgcggtgttcccgggaatgcaaggtggtccattgatgcatattattgctgctaaagccgcttgtttttatgaagcaatgcaaccagaatttaaagaatatgcagctcaagtaattaaaaatgctaaagcattagaaacagcattaaaagaagagggattcagattagttgctgacggaactgataatcatctgattttaattgatgtaaaagcaagttgcggtatttcaggtaaaaaagcagaacgtttattagatgaaattaatattactgcaaataaaaatgctatcccatttgatacagaaaaaccatttaaagcaagtggtattcgggttgggacccctgcaatgactactaaaggatttacagaagaagattttagagaagtaggtaagattattgcttatcgcttaaaaaatgaagaaactgatgaaatcaaagaagaatgcttaaagagagttagagcattaactgataaagtagaaatgtatcatgatataaaatacatttaaggagtgaatttatatggcaacgaccatcctcaatcatgcattaattgatcataaattaacaattatgcgtgataaagatacgaaaacaatcgtatttaaagataacctagacgaaattgcaatgttaatggcttatgaggtaactaaagaattaccattagttgataaggaaatcgtcacaccaatttgtccaatgattggaaaagaattgaaaaaacaaattattcttgttccaatcttaagagcggggattggtttagtcgatggttttagaagaattataccgactgctaagattggtcatataggaatggctcggaacgaggaaactttaattcccgaagagtattatgctaaatttcctagtggtttagaagattctatcgtaatcatcgttgatccgatgttagcaactggtggtagtgctagtgcagcgattacaaatattaaagcccgtggtgctaaagatattcgtttagtctgtttagtaggtgcccctgaaggtgttaaagtaattgaagaagatcatcctgatgttgaattgattttagcgacgcttgatgaaaaacttaatgaaaaaggctatattgtgcctggtttaggtgatgccggtgatcgtttatttggtactgattaatatttgagatacttcaaaagtggttaaaacgtctaattatgaaattaattatagtgtttagtactgaaatacttgttctataaataaattatcatagtgttaaataattattacaaatttttataagaagtttacataaccaaaagactatagtagaatacaagagggattatggatcaagataagaagaaaatgttaaaagatttattcttttgcctacaattgggttttcaggtaattggagcatttctattagctgtaattgttgggctgcgcttagataagtattttaatacccatcccacgattctactaattttattgtttttagcctttggctacgttattaaaatacttttaggagcaggtaaagaatgaacgaaaaagatgttttaaaacaatccgtaaaagtatttattggcggattaattatcttttctatcgtaggatttgtcctaaaacaaattagttttccactaggatttatcttaggatatgcggtcagcgttttatcattctatattatcattgtaatgagtgatgtgatcttaaaaatgggtcaggcgattcgatttgttgtaatgatgtttatagctaagatgatattgtatattgcaggtttcatgctagcaatcaaatttgatgatatctttaatttgatcagtgttttctttggatattttgtgaccaagattacgatcaatattttaggatatataaaacgctaaatattttaaggaggtgaaatgagtgacaattcaagtagaattaatttattcactagtcattatggtttgtttaggcgtgttctttgtctatgctggaaaaaaagtagcattggcggatccaactgtcaaaccaaaaggaattgtattggttgttgaaacgggagttaaagctattgatgattatatgaaatcaatcatgcctaagaaatttgccaagaactattatccatattttgcaatggtattttgttacatattgatcagtaacttatcaagtttgattgggtttgaatcaccaacctcaaactactctattacctttgcgatgacatttattacttttatattgattcaatataatgcgttgaagaaaaagggattttttaaatatgtgtgggatactgtgtggcccccaactaatattttaagtgtcttatcaccattaatttcaatttcaatgcgtttatttggaaatattttgagtggatctattttaatgacgttgatttatcaatttacagcatggatttcattccatgtaatcaactttaactttttaggtccaattattgcccctgtattccattgttattttgatatttttgcagggtgtatccaaacattagttttcgtaactttatcatcaatcttaattatgatggaaaacgaagacgacgagtaagctctaatctaggtatcctagttagatataaattacaaaaaaatatatagaaaatattggaggaaatttaaattatgacagatgtaggtttaattgcaattggtgcaggtattgcagtatgtgctggtttaggaacaggtatcggagaaggaatttgtgcgagtaaggcggtagaagctttaggtagaaatcctgaaatggaaggtaaaattagaacgttaatgattctagggattgcattaactgaaactgcagctatctatggtttattaatttcattaattttattatttgtatactaatattagctaaggaggaatacgtatgccagatatagcatcgaaattattccctaatgtaactacaattattattcaattactttcaacaggagttttacttcttgtctttaaaaagtatttatgggttcccgttcaaaattattttgctaaacgggcagaatttattgaaggaactgtaaacgaagctaaagatatgaatgaaaaagctagagcactgatggaagaaagtgaagaacaagcacgccaagcggcagttcaatatcgtgaaattgttaatttagctaaagaagatgctttaaaaacaaaggcaacgattcaagaacaagctaatcaggaatataaagctaaactagatcaagcacgtcgtgagattgaggctgaaaaagcgcaggcaaaagcagcgatgaaacaagaaattgttgaggttgcgattgatgtagcgactaaagttatgaacaaagaaatggatacaaagactaacaaagctttggttgaagactttgttgaagaagtggttaactaatggatgcagtagcagtaagatatgcagaatcactatttgatttagctaaagagatgaatcaagttgaagcatattctaaagatattgatttaattagaactgtttttgaaagtgatccaagttttgttccgttctttagtcatgttttaatagaagatgaagctaaatgtgcattattagataagagttttaaaggacaggttaatgattatgtcgttaattttctaaaacttttagttagaaaaagaagaatgcgttacgttatggaaataattgaagcatttaaagcgttaacgaatgagcattttggaatcttagaaggtattttatatactaactatgatatcagtgtgcaagaagttaaagaagtggaagatgctttaagtaaaaaggaaaataaaacgattcgtttaagagtagttaatgatccatcactgattggtggaattaaagtcgaaataaataatcgtgtttttgatggctctatcaaaaacaaagttgcattattgaaaaaagaactattaagaaagtaggtgaaaatagtggggcttagaccagatgaaattagtgctttaattaaagaacaaattaagcactttgatgatgtaatcgaacttaaagacgttggaacagtcatgactgttggcgatggtgttagtttaattcatggtttagataatgccatgctaggtgaattacttgccttccctaatgatgtttatggaatggtaatgaacttagatgaagattgcgtcggagccgtactacttggatctgaaagtacgattaaagaaggagacgaagttaaacgtactggaaagattatggaaataccagttggggatgagatgttaggtcgagttgtaaatcctttaggacaagcaattgatggtaatggagaaatcattacagcacatactcgcccaattgaaagagttgccagcggggttatgacaagaaagtcagttgaccaaccgttacaaacaggaattacttcgattgatgcaattattccaatcggtcggggtcaacgtgagttgattattggagatcgtcaaacaggaaagactgcgattgcaatcgatactattttaaatcaaaaagatcaagatatttattgtgtttacgtagcaattggacaaaagaattcaactgttgcccaaattgttgaaaagttacgtaaaggtggcgcaatggaatatacaacagttgtgtcagcatctgctagtgaacttgcaccagtgcaatatattgcaccgtatgcagggtgtgcaattgctgaagaatggttagatcaaggtaaagatgttttaattgtttatgatgatctatctaagcatgccgttgcttatcgtacggtatcattattattaaaaagaccaccagggcgtgaagcttatcctggagatgtcttctatttacattcgagattattagaaagagcatgccgcttaaatgaagagaatggtgggggttcaatcacagccttaccaattattgaaacacaagcaggtgatatctcagcatatattccaactaacgtaatttcaattacagatggacaaattttcttacaacaagaattattcaatgctggatttagaccagcaattgatactggactttcggtaagtcgggttggttcagctgcacaaatcaaagcaatgaagcaagtatcaggttcactaaaacttgaattagcgcagtatgctgaaatgcaagcatttgctcaatttggttcagacttagatgctgctacgaaagcaactttagatcatggtgcaaaagtgcgtgaggttttaaaacaagcacaatattcaccacgaactgtatcaacgcaagtaattacattatttgctttaaaatatggatttactaagacattagaagtggaacaggtgtctgcttttatggatcagttagttgaacatatcaatatgacgcaaagagatattattgatgaaatcaatgaacaaaaagcaatttctgctgatttagaaaaacgcatgaaagatgttatgagtgcttttgtaacacaattcgaaaaaactcaaacaaaggggtagttaactatgcctggaggaatgcaagaaattaagcggagaattaaatcagttgaatcgactaaaaaaattactaaagcaatggaattagtcgcaacttctaaacttcgtaaaacaagaaatcaattagaacagtcgaaaccttattatactaatgttgctcaaactgtagcggagatcttagctaattgtaagggtaataatgatagtatctatttagttgaaaataaagatattgaaaaagaagtatttattgttattgcttcaagtctaggactatgtggtggatataatgccaatatctttaaagaaattaaaggtgcaatcaaaccaggtgattatgtttatagtattggttcaaaggcaactagttatttattaaaaaatcatcaaggggtaacggatcataagtttgatgatttaaatacaacttttgattttaaagatgtaactaagttagttgctgaattaactaaaatgtatcgtgaaaaagaaattagtaaaattaagattgtttatacggagtttgttaataacttaacatttagaccaagaattgttacgttattacctgttgatccaagtgattttgatcatattgaaatctcaaagaaatcaacattatttgaaccaagtccagaggaagtattagacagtttgattccaatgtatcttcaagcagtgatttatggttatatcattgaatcagctacaagtgaaaatgccgcacgaagaacatcaatggaaaatgctaatgataatgccgatgaacttacagaacaattattattaaaatacaatcaagctcgtcaaactgcgattactaatgaaattagtgaaatcgtagcaggagctaatgcacaataaggaggtgccgtatgtcacaaaatattggtaaaataattagtgccaaagggccagtaattgatatccaatttgatggtgataacaatttaccagcattaaatacggcgattgaaatccaaaatggtgatgaacttctagtagttgaagtcgctcaacatatcggagatgatgtagttcgttgtgttgcaatgggaccaactgatggggtaaaacgaggaatggatgctcttaatacgggaaatccaatttctgtacctgtcggaaatgaaactctaggaagaatgttcaacgttttaggacaaccaatcgatggtaaagaagcattaggtgatagcactaagaaaatgccaattcaccgatctgcaccgacatatgccgaacaaagaacagaaactgaaattcttgaaacgggaattaaagtagttgatttgatctgcccatttatcaaaggtggaaagattggattattcggtggtgccggagtaggtaaaacagtattgattcaagaattcattaataacattgctacagaacatggtggtttatcagtttttgctggagttggtgaacgtagccgtgaaggtaatgatttatattatgaaatgaaggaaagtggtgttttatctaaaacaacactagtatttggacagatgaatgaacccccaggagctcgtttaagagttgctttaacgggtcttactatggcagaagaattccgtgatgaacaaggtcaggatgtcttattattcatcgataatattttccgttttactcaagctggatctgaagtatctgccttacttggacgagtaccatcacaagctgggtatcagccaactttagcaaccgaaatgggtgctttacaagaacggattacatcaactaaaaaaggatctattacttcagttcaagcggtatatgtacctgctgatgacttaactgatcctgctccagcaacaacatttgctcatcttgatgctaaagtagtattagatcgttcaattgcggctttaggaatttatcctgccgtagatccattaaattcttcatcaagagcccttgatccattagttgtagggactgaacactatgaggtagcccatggggttcaacaaatcttacaacggttccaagaattacaagatattattgctattttaggaatggatgagttaggtgaagaagataaattaacagtagctcgggctcgtcgtgtccgtaactacttatcacaaccatttacagtagctagtcagtttactggtatggatggtaaatatgtccgtgttgctgatacaatcaaaggatttaaagaaatcctggaaggtaagcatgatgatttaccagagcaagcattccacaatgtaggtacaattgaagaagctattgaaaaagcgaagacattagcaaatgactaaatttaagcttaagatagtaacaccaagtggtatctaccaagaagtggaagttaatcagttaaatcttcgcacaacagcaggacaggtaggaatcttggctcatcatatgcctttagcaagcgggattgaaatctctgagatgagttatatcattgataaacaacgtcatatatttgccatcggtggtggatttatatatgttaatgatgatgaaacaaaaataattgctaattcaattgaatctaaagaggaaattgatttgaaccgtgctaaagaagctaaacgtcgggcggaacaaagaattaaggaagtaaccgaaaaaactgacttattgcgggctgaaattgcacttaaaaaggcaattactagaataaatgttaaagaattataattataaaagtctgacttaggttagactttttaatataaacggtatttaattaattataaattatatttgattgataaattaaactgattaagttacaataatatcaagaaagtgattaatatgtatacagtaattattggggatactaagaactagtattaacagcaaagtcgattgcatgttataataagattgcagaagatagtgattttgccgaatattatctgattgggacactttatagtgtccttataacaattttattttatattattttgtttaaaatataatacaaaaggtttataaaatgattcaggtgagagcctggatttttttataaatatgttgaatatcctagttttattaatttaattattctttttaaagaaatttattataattatatttttatcaaaaatatttagtatattaaacaataaattttattttataaaattaggattgctttttaaaaactaatgatttataatttagatattgcaaaaggagttatctattttgcgggaatcttttgaccactcttaggagttaaagccatacggacagctaggtcaaaggccggaccggcaactttgttgccttattgatagaacgaaagttcgaattttataagttgatgctaaattccttagcattgagttggtgactatacaaccgtgtgcttaggcacatcacacttgtgaaacaatcaataagagtagtaaaagtaattcttgctatatagactctgacgctaataatataggatattttttgatgttctaataatatgtcgtattgatactcaagtgggattgtacctgcttgagtttttttatggagaaggggaaactggtatgaatgagaaattaaaattatatggttttaataacctaactaaatcattaagttttaatatttacgatgtttgctatgctaaaggtcagagggaacaaaaagattatattgcttacattgatgagcagtataattcaaagcgattgactgatattctttatgaagtagctaatatgatcggagcccatgtattaaatgtttcaaaacaagattatgatccccaaggcgccagtgtaacaatgttattagcggaagaagagatgttagaaagtcgtcaaggaaaaatggaagaagttgatgatcgagttattttagggcatttagataagagtcatattactgttcatacgtatcctgaatatcatccagaaacaagtattgcgacatttagggtagatattgatgtggctacttgtggagaaatatcaccgttgtcaacgttagattttttaattagcagctttgactctgatatcattacaatggattatcgggtccgcggttttactcgggatattaagggaaagaaactttttatggatagcccaatgacttcgattcaacagtttattgatgttaaaacattacttaactatgatgctacagatattaatgtatatcaggctaatttgttccatacgaagatgttaatcaaagaaattgatttacaaaattacttatttaaaacagatatctatgaattgccgccaaaggtaagacttgagataacgaataatttacgacaagaaatgattgagatttacagtggaagtaatattttttaggaggcaatatgaaattagatcaaagtagaatgcctatttatgaagctttacagcaaatgaaaagagaacgtttagttccctttgatgttcctggccataaacatggtaaaggaaatccagaattgacagattttttaggtgaaaagtgtatgagtatcgatgttaattcaatgaagccattggataatttatgtcatccagtttcggtaatcaaagaagcagaagaattagcagctgatgcttttagtgccgctcatgctttttttatggtaggcggaacgacttcagcagttcaaagtatgattatggcaagtgtaaaagcaggagaaaaaattattatgccacgtaatgtccatcgtagtgccattaatgcgatgatcttgactggggcggttccgatttatgtaaatcctgatgttgataaacgattaggaatatctctaggtatgtcacttgatcaagtagagcaagtaatcaaagataatcccgatgcaaaagcaatcttagtaaataatcctacgtattatgggatatgttcaaatttaaaagcgattgttgcattggcacataagcataatatgcttgctttggtagatgaagcacatggaacacacttttatttcaatgatgatttaccgatgtcagcgatggaggctggagcagacatggcgagtgtcagtatgcataaatcaggtggaagcttgacgcaaagctctttcttactgttaggagaaaatgtaaatgctgattatgtacgtcaggttgttaatttgacacaaacaacaagcggttcgtatttattgatggcgagtctagatatgtcacgtaaaaatttagctatacatggtaatgagatttttaacagggttcgtcgccttgcgggatacgcacgcacagaaatcaatcaaattggtgattattatgcttattgtaaggaattgatcaatggggatagtgtttatgattttgatgtaacgaaattatcaatatttacacttgatatcggattggctggaatcgaagtatatgatttattaagagatgagtatgggattcaaattgaatttggtgatattggaaatattcttgcttatatctcggtcggtgatagtgaagcaaatattgagcgtttaatcggagcacttttggaaatacgccggcggtttaagaaggatcggacaggaatgtttgatcatgaatatattaatcctgaagtagttatttctcctcaagcagctttttatggagaaaaagaatcgttgccgctttatcaaagtattgatcgagtctgcagtgaatttgttatgtgttatcctccgggaattccaattttagcaccgggtgaaaggatcacgaaagaaattctagattatattcaatatgctaaagaaaaagggtgctttatgactggtcctgaagatatggcaataaataaacttaatgttttaaaggggagatgaaataaatggaattatggtttacggagagacatacaaatggtgtgaatttttcgattaaagtagattgtcagttatttagtggtcaaagtgaattccagaaaattgatatttttgactcaaaagaatttggacgatttttagcgctagacggttatatgatgctaacggaaaaagatgagttcatttatcatgaaatgattgttcatgttcctatggctgttcatcctgaagtcaaaaaagtattagtaattggagcaggagacgggggtgtaattagagaattatgccgttatgaaacgattgaaaagattgatatggttgaaatagatgagttagttgttgaagtaagtaaaaaatatttaccgatgacagcatgttgttttgatgatccgcgattacaaatctattatcaagatgggttaaagtttgttagaggtaaagaaaatgaatatgatttgatcattgttgattcaacagatccttttggaccgggtgaaggactatttacaaaggaattttatggtaactgttataaagcattaaatgatacaggaattatggttaatcaacatgaaagtcctttttatcaagaagatgctgttgcaatgcaacgggctcataaacgaattgttgaaagttttccgatttctcgagtctatcaagcgcatattcctacctatccttcagggcattggttatttggttttgcttcaaaaaaatatcatcccatcaaagattttcaaaaaacaaaatggaatgctcgagggatgaaaacaaagtattataataccggcattcatgtaggttcgtttgcattaccaaattatgtagaggagttattaagagatgtggaataaaaatatacagacgtttattggactagaggcatcgtttgatgaagctgagtgtgtaatctttggagccccaatggatagtaccacctcatatcgaccgggaactcgttttgcttcatcttcaatgcgccaagagtcatttggtctagagacatacagtccctatcaggataaagatttagaagatattaaagtttttgatggtggtgatcttgaattaccatttggaaatccccgcaaagcattagatataatcaaagtaacaacaaaaacaattattaaagcaaataaattaccatgtatgattggtggcgaacatcttgttacgttaggagcttttgaggcagtatttgagaaatatccagagatacgtgttattcatttcgatgctcataccgatctacgtgatgagtatttaggtgaaaaactttcccatgcttctgtgattagacgaatatatgatttaattggtgataataaaatatatcaatttggaattcgtagtggtgaacgagaagagttttgctttgctagagaacatactaatttaaataaatttaattttacaggactatcaaaagcaattgaggcatgccgcgggtatccggtgtattttacaattgatctagatgtcttggatcccagtgtatttccaggaacaggaacgcccgaagcaggaggcgtgacttttatggaactattagaggcgatgattgttgtaagtgagctaaatgtagtagctatggatattaatgaattatcacctgtttatgatcaaagtggaggatcaacggcagtcgcttgcaaagtattaagggaattattattagcaatgaataaaggagaaaataaatgaaaagaacgttaattattggttgtggtggagttgcaacagtagcgattcacaaatgttgtcaaaacagtgagatatttgaagaaattatgattgcgtcaagaacaaaaagtaaatgtgataaactaaaagcgcagttagatgggaaaacaaaaacaattattcatacagcacaagttgatgctgataatgttgaagagctagttgctttaatgaaagatttccaaccagaggtagttttgaatcttgcattaccataccaagatttaaaaattatggatgcttgtttggaagctggttgtcattatgtagacaccgctaactatgagccggaagatacagcaaaatttgagtatagctggcaatgggcataccgtgaaaaatttgaacaggcgggattaacagcgattcttggatgtggttttgatcctggggtaacaggtgtatttagtgcttacgctttaaagcatgaatttgatgaaattaattatattgatattttagactgtaatggtggggatcatggatatccatttgcaacaaattttaatccagaaattaatattcgcgaagtatctgccaacggaagttattgggaagatggacattgggtagagacaaaaccaatggaaattaaacgtgaatatgattttgcccaagttggtaaaaaagatatgtatttgttgcatcacgaagaactggagtcattgggtttaaatattccgggaatcaaacgaattagattctttatgacttttggcgaaagctatttaacacatctaaagtgcttagaaaatgtaggaatgacatcgattgaaccaattgaatatgaaggtaaacagattattccattgcaatttttaaaagcagttctaccagatcctgccagcttaggaccacgaacagttggcaaaacaaatattggatgcatttatcaagggaaaaaagacggtcaagaaaaaaaatattatttatataatgtatgcgaccatcaagaatgttataaggaagttgggtctcaagccgttagttatactacaggagttccggcaatgattggaacgatgctgttattacaaggtcaatggaagagagccggtgtttataatgttgaagaatttgacccggatccatttatggaagcattaaataaatggggattgccatggattgaagatcataatccggtattagtagattaatgaagacaccatattatttaattgatgaacaattattagaaaaaaatttaaaaatacttcatacggttaaagaacgaactggttgtaaaattctattggctcaaaaatgtttttcaatgttcagtgtttaccctctaatagctgaatatttagatgggacaactgctagtggactatatgaagctaagcttggctatgaagagatgcataaagaaaatcatgtttttagtaccgcctatcgtgatgatgaaattgaagaaatcatgaatatatgtgaccatgtagtctttaattcatttaatcagtggcaaaaatatcaaaatctagcaaaacaaacaagtacttcatgtggaattagaatcaatcctgaatgttcaactcaaataggtcatgaaatctatgatccttgcgcaaagttttcacgaatgggggtaacattagaaaactttaaggaagaactgcttgagggaatagagggactgcattttcatactctatgtgaacaaaacagcgatgatttaataactactattagggctgttgaagaaaaatttggtaagtatttaggacaaatgaaatggttgaattttggtggtggtcatcatattactcgtaaagactatgatcttgaaaaattaataaaaattattaatgaaataaaagaaaaatatcaagtacaagtatatttagagccaggtgaagctgtggctttaaatgctgggtttctagtttcgagtgttctagatattacccacaatggtatggctatcgcaattatggatacttcagcagcttgtcatatgccagatgtattagagatgccgtatcgaccagaaattatcgatagtgcactaccaaatgttaaaacatacacatatcgcttaggaggaccaacttgtttagctggagatattattggtgattattcatttgaccagcctttacaggtaggacaacagttatggtttaaagatatggcaatttattcaatggtaaaaaataatacttttaatgggatgaacttacctagtattgttttaaaacaaaaagaaaaacttaaaataatcaaagaattcaattattgtgattttaaaaatcggttgtcataaaaaattaggctgttagcctaatttttatctttaataagatcatcaaataaatattctaacatatttaagacaccctcatgtcgattgtttttgaaagtaagataggtagcttttttctttaatgaggaaagaccatttttcataataatcccaataccggcattgtttaataattcttcatcattaccactatctccaaaagctaagacattttctaaatttaaattatttaactgacataaatattttacagcataacatttattgacttctgctttaacaacttcaacacagtaagggttggtgtaataatattgatatagtccaggaaattttgtttgtgcagcagcttcaaaaagctttaattttctaggtgaagaaagtaaacaaatttttccaagtttattccaaggtactacagcagtatttttataaaaagtgaggtcgggataacgtttagtaaatattcgaatcaaggggattaaaaagtatagccaattatttaaaatcatttgatatttatgatcaaaattagcacgtatatttaaccggtaataaagggctaattgaagtagttcgttaatttctatttgttctaaaaaagaaaaagatctacacttattgtgagtaagatcataaatctctattccattacagcaaatcacatagccatgatatttttccagctgtaattgttcaatgtatggctttaattcataaaagaagcgacctgttgcaagaacaagagtataaccattttcttgtaatttaattaaataagtgattgtagctgatgatatttcttttttatggttaaacagtgtgccatcaagatcacaaacaatcatttttattttatttaactgcttttttgttattttcattattctcgatccctttgttatttaatgattccattttagctaatatttcttaaatcatcaagataaggattataaatattatgttaagacaaaaacagcgctttatttttgtataattgagcgtataatagagaaataagtttgaaattatataagaatatggtaaactaaacaaagtctatataaaagttatgctagtctaacaattgagataggagtgatttaatggaaatattattagaaccaattcaagaatccctgatgacagtaccagtattatttttggcctgcttattagtagaatacatatctaatcgtgatgttgtcaataaggtaatggagtttggaaaagtcggtccttttatcggagcgattttaggaagtatccctcagtgtggtttttcagttattgcggcccgattatattcgatgcgttacttgacaatgggaactttattatcaatctttattgccacaagtgatgaagctttggctattttagtagtacatcctgatttatgggaaatgttagttgttttaattgttttaaaaattgttttaggtacagttaccggttatgtagtagatcgtttgaatcatcgaagtcatgatgattatgaatatttacaagtagagccttgtgattgtggttgtcaaaatggtatttggttaccggctttacgacatacactcaatatttttatctttattttattaacaaatatcgtctttacattaattattgcggggattggtgaagaaacagtaaccaaccttttaaaaacaaattggatcttccagccaatcattgcgggagttattggttttatccctaattgtgctggttcagttatactgacacaattatatgtgtccggtggtttaagttttggtgcattactgacaggtttaacgacaagtgccggtgtaggaacattagctttaataaaatataatgagaataaaaaagacacatttaaaatattatttatttcgtatgttattgctttagtggttggttatatagcctcattagtaatgctatagattaagaggttcttaattaataagaaccctttttggttacaaaataaattatttatagttgaaaaagaatctatttaaaagatagtggttatagtatgttattaaataatactataaccttttattatactatcatggatttagaaagattcgttaccacttattaatttgtaagaaattttatgactaaagaattgttatcctggtttaattttataataaatgagtacaataaattaatagagcatatcaaatgacaattttagtaataaatactattatggttttgtaaggaggaactaacaatgagacaagatgatgatttgaaaaaggttgtattagtagggactggttttgtaggaatgtcaatggcatattctattttaaatactggtggtattgatgaacttgtattaatagatgtggatcaagaaaaagcaattggagaggcaatggatattagccacggtctaccatatagtaaaagtagtttaaaggttaaagctggtggttatgatgaatgtaaagatgctgatattgttgtaattactgctggagctgctcaaaaaccaaatcaaacaagattggaattagctagtgttaatgcaaaaattatgaaatctattactgagcaaattatggctagtggatttgatggaattattatcgttgcaagtaatcctgttgatttgatgagttatgtagtccaaaaagtatcaggattaccaacaagccgtgtaattggtagtgggactattttagatacagctagattacgttatttattaagtgaatatttgaacatttcctcaacaaatattcatgcgtatatattaggtgaacatggtgattcttcatttgtaccatggatgaatacttatattggctgcaagagtatgatggaatatattgtggaaatgaatatcgatatgaacgagatgcataaaatttataaagaagtacaacaagctgcatatgagataattaaacgtaaaaatgcaacttattatggtataggtctatctttaaatcgtttaattacagcaattttaagtgatgaaaatgccgtattaacagtttctgcatatcaacaaggtgaatataagcaagaagggctatatatcggggtacctgcaatcattaatcgtcaagggattagtaagatcatgacactgcatttaaataatgtagatcaacataaatttgatcgtagctgtgaaactttaaaagagatgattgatggtgaattagaggcaattattaatagctaatctatgatataatgaggaagagtgggtgaaataatgaagaaattactcagtattttcctaattatgttatgttttagtggctgtaaacaaaataatgattctgaattaatcaaaactgaagcagttgaagctcaacaaacggcatttgttgaaaaagaaggcgaagtacttgttccggaatctttgcgaacagttcaattaccaatcgttggtgatagtcgtgtaattgtgattgacgcaggacatcaacgacgtggcgatagcaacaaagagccaattggacctggagctagtcaaacaaaagctaaagtaacaacaggagcaacgggaataagtacaggtaatttagaatcagcaattaatcttgaagttgcattaaagttacaaaaaaaattagaagattcgggttatcaagtaattatggttcggacaagtcaagatgtgaatatttctaatcaacagcgtgcggagattgctaataaaaataatgctggagcatttattcgactgcactgtaatagtgatgacagtagtagtattcatggaactttaactatggcaccatcggaatctaatccatattgtagtcaaattgctacagcttctcaacgattgtcaaaaacggttgtaaatagtatttgtaatcaaacaggcagcaaaaatcgtggcgttattattactgatgtgatgagtggaataaactggtgtcaagtacctgtaacaatagtagaaatgggatttatgtctaatccagatgaggataggttattaggagacagtacttatcaagataaaattgttacgggaattgttttaggaataaatgaatattttaaaaactagagttgaaagtattaggaaagttccgaaactttcagcttttttgtataatatttttttaatatagtaataaaatatagtttaaaatagaactaattggagaatgtatgataaagttattaagaattctaaatgatgtaaaaaacttatgattatttatatcaaaatgtaattaaacagtatcaaatcatttgcagtgaactagatattttgcttttcctatacaataattccgtgcttgatagtgctaataatattgttgagcagcaggggatgattaaaatttgtcacataatattttataatgttttttaagttttactaaaagttattaattttttatgctaaaatgtagtaatgtgaggtgtagacatggaagactttattcgcccaaatcataatccggagccaaagttgaagccaaagaaaacaaaacatattagagaaaccctattcattgtttgtatgattgtttgtttggcagttggttttgtatctggttatgtagcaaaaaaaacagttccgactaacagtactagcaaaaatgcagaatcaattattgatgaagcttatgaaatattagatgaagcttggttaaatcctaatgataaggatgttgacatcaaagggaatactattaccgctttagtagaatcgctgggggatatgcattcttcatattttacatatgaagaatctaagacatataaccaaagcgttgatgggaactatgaaggtattggtgtagcacagcgaactgttagtgaaggtacaatggtaatgcaggtgtataaaaattcgccagcagaaaaaagtggtttacaagttggagatattattacaggcgttgacgggaatagtgttgctggtaagagtgctgatgaaatttctgatttaattcgtggtgaagcgaatactaaagttaagttgacaattatacgtaatactgaacaacaagaagttgaagtagagcgagccaatgtagatagtgcggtaactagtgaaataagagataatgatggtaaaaaatttggttatgtaaaaattaatacttttggaagtactacagctgatgatattgaagcagctttacagacttttactgctgaaaaaattgatactttggtcttagatctgcgagataatggcggaggatatcttacagctgccactgatgtattaagtttatttatgaaagaagataaactgctttttcaaatggaaactaaaaacggtgcaatcgagaaatacaaggctaaagattgtcaaaaatataattttataaatggatatattcttgtaaatggaaatactgcatcagcatcagaagttgttgcaggagcattacaagaaaaaatgaattataaattagttggggatcaaacttatggtaagggaacggcgcagacgcaaaaacagctcagtgatggatcagtcttaaaatatacttatgcaaaatggttattaccaagtggtacatggataaatggaaaaggattgacacctgattattctgtaagtaatacggatacaagtggtatttataccaaagcactggaaactgatatgggatatgatagtgttggtacagcaattgcctcaatgcaaaaaatgttaagtattttaggttatgactgtggacgtaatgatggatatttttcacaacagtcagtggaagccttaaaacaatttgaacaagctaataatttaactgttgatggtatttatactaatagtgatcggcagaaattagaggctgcggtaatcatgtatgctaatagtgaaaataatgattatcagtataaaaaattaatggaattgataaaataactatgcctggcatagttattttcatcatgggcataattcttttaacttcgctgttttcttggtataatagaaaggacttataggaggtgttacaatgcaaaaatttaagcttgtttctccgttttctccaatgggagatcaagaggaagcaattaaacaattagttgcaggaattaaagaaggaaaaaaagaacaggtcttactgggagggaccggtactgggaaaaccttcactgtttctaatgttattgctgctgtgaataaaccgacacttgtcttggctcacaataaaacattggcaggacaattatattcggaattaaaagaattttttcctgaaaatagagttgaatattttatttcaaacttcgatttctatcaaccggaagcttatattcctgggcgagatttatatattgataaaaatgctaaaacaaactatgaaattgagatgctgcgcagtgcggcaatgaattcgttaatagaacgggaagatgtcattgttgttgcttcagttgcttcaatttatggattaggaaatcctgaacagtacaaagaaatgatcttttcactgcgggtcgatcaagacattgatcgtaaagagttactaacatatttagttgatcggcaatatcaacgcaatgatattgaacagactaaaggaacatttagagttcgtggggatgtcattgaaatagttccaggacatactgaaagctggttaattagaattgaattatttggtgatacagttgaaagaatcagtgaagtggatcctctgactgggcatgtcttgggcgtatacaatacatatacgatctatccagcttatggatatgtaacgaaaaaagaacaaattttaaaggcttgtgatacgattacggcagaattagagaatcgtttagaaacattcaaagcagaaactaaattactagaacatgaacgtttggaacaacgaacgcgccatgatgttgagatgctgcgggaagtggggatgtgtcctggaattgaaaactattcacggcatattgatggtcgtgatgaaggacaacgcccttatacgttgattgattattttcctaaagattttttaatgatcgtcgatgaaagtcacgttatgttgcctcaggttcgaggaatgtataatggggatcgttcacgtaaagagacattagttgaatatggttttagattaccaagcgcgcttgataaccgcccattacgcttcgaagagtttgaaaaaattataaatcaagtcatttatgtatcagcaacacctggggattatgagttagaacatgttgaaaataaagtagttgaacaaattattaggccaactggactacttgatccggttattgaagtacgaccaacaaaggatcaaattgatgatattatcagtgaaatcaaaattcgtcaagatcgtaatgagagagttctaataacaacattgactaaacgaatggctgaggatttaagtgcttatttgaaagaacttggaatcaaggtagcttatctacatagtgacacaaagactttggaacgaaccgagatactaagggatctacgacttggcaagtatgatgttttagtcggaattaatttattacgagaaggtttagatttaccagaagtaagtttagtatgtattcttgatgctgataaagaagggttcttaagaagtaaccgttcattgattcaaacgattggtcgggctgcccgtaacagtaatggtgaagtaatcatgtatggtgataagattactgattcaatggcttatgcgattgaagaaactaatcgtcgtcgtaagatccaagatgcttataataaagaacataatattaccccaacaactattcataaggaaattcgtgatgcaattcgtggtcaagaggtcatcgatgatgctgcaagtctagttaaaaaaggtaagaaagcaagcaagaaagataaacaagttatgattcaagaattagaaaaacaaatgaaagatgcagcgaaggtacttgactttgaacgtgcgatggaacttcgcgatatcatcatggagcttcaaggtgaaaaataggtatactttcagtccacttgctaaaaagatctttaaggatatagacgagcaccatggtagagcttttctagttggaggaatcgttcgggatatgttgatctacaatagggttgattatcatgatgtagatgttgaggtatatgggcttagtgtcgatgaattggaagaattattagctaattatggcaatgtcaatagtattggtaaatcattcggaattttaaaattagatgttttaccaaattttgattttgctttgccgagaacggaaataaagacaggtgagagtcatcaggattttgatgttacagtaaatcaaaatttagatttaaaagttgcggcatcacgacgtgatctaacaatcaatgcgttgatgtatgaaataaagacaggaaaaatctatgatttttttcatggtcaagaagatattgaaaaaagaacattacgaatggttagtgaaacaacttttattgaagatccgttaagagtcttgagaacagcacaatttgcttcacgtcttgatttctgtattgagacggcgactaaattaatgtgtaaaaaaatggttcaaaataaaagtttggataaactaagtaaagagcgggtatttcaagaatatagtaagctcctcttaagccagcagccttcaattgggttaacttttttaaaggagatcaaggctttgtggccatgtttagatgtattatcgaaaactatgcaacggcttgattaccaccctgaaggagatgtatggcggcatactttattagtaactgatttagcggctttatgctgccataaaacaagtaatccattaggttttatgtggagtgctttattacatgatattggtaaagctacagtaacaactaaagacggtcatgctccgggtcataatgaagcgggggtaaagatttttaatcaagaagtaaaagcatttatcccagataaacagttacaaaaatatattaaaacaatgattttctatcatatgcatttaatgaatatggtcagaaatgaagcaaaggattatagctattttaaaattcttaaaggaattgatggaatagttacgattgaagacttaattttaatcacaaaatgtgataaacttggtagatacaaagatgaacatgaaaatattaatcgctttgattatgttatgaaagaaaagatggcacggctatcaaccaaagctcagttgccattagttgacggatatgatttaaaggcgttagggattgaaccgtcatccaagtatagcgagttattagattgggcttatgatcttcaattacgggggcacagtaaagcagcaatcttaaagatggtagaaggtaggtaaaatatggaacatgataaactagtcattaaaggggctagagagaataacttaaaaaatattgatatcgagattccaaaaaataaattagttattatgacgggattatctggttcaggaaaaacatcgctggcatttgatacaatctatgccgaaggacagcggcgttatgtggaatcgttaagtgcttatgcacgccagttcttaggaaacatggaaaaaccggatgttgatagtattgaaggtttgtcaccggcaattgcaattgatcaaaaaacaacatcaaataatccgcgttcaacggtagggacggttactgaaatttttgactatttaagattactttatgcgcgtattggtaaggcatactgtccagagcatggaatcgtgattgaatcgcagacaatcaaacaaatggctgatacaattgataaatatccagatggtagtaaattacaagtattagcacgagtagtaaagaatcaaaaaggtacttttaaggatttatttgaggatttattgaaagatggttatattcgagttcaagttgatggtgaagttaaactattagatgaaggaattgaacttgataaaaataagaaacataacattgatgtcgtaattgaccgaattatcaaaaaagaaggttatcgtagtcgtttgattgattcacttgaagtaggtttaaaactaacaggtggagaagtagttgtagctaatttaagtgatggcagtgaagctttattttctgagcatttagcttgtccagagtgtggttttagtgttcctaaactagaaccaagattattctcatttaataatccactaggagcttgtccggattgtcgcggtttgggaataaaaaatgaagttgatgatgatttattgattcctaattgggatttgagcataaatcaaggtggaattagatattttaaaacttcagtaggaactgaccgaattgaatggcagcgctttttgatcctatgtaaaacatataagattgatttagataaaccattgaaagactttactaaaaaagaattaagaattatcttagaaggctcagataaaccaatttcttatgagattgtttctagtagtggtaatgtttctaaaactaatcgtcctattgaaggtgttaaaacattgattaaacgtcgttttgaagaaacgacttcttcttggtcaaaagaatggtatgcttcatttatggctgaacatacgtgtccaacttgtggaggacgcagattaaatgatcaggttttaagcgtacgagtaggtggcttaaatatcagtgaatttaccgatatgtcaattgaaaaagctttaaaattcgttgatgaattaaaattaaatgaatatgaagcgaagattgctaatcttgttttaaaagaaattaaagaccgtttaggtttcttaaatgatgttggattaggatatttaacattatctcgtaaagcgggtggattatctggtggagaagcacaaagaattcgtttagcgacacaaattggttcaagattaactggggttttatatgttctagatgaaccctctattggactccatcagcgggataatgataagttaattgccactttacaaaatattcgtgatttaggtaatagtgttctagttgttgaacatgatgaagacacgatgcgagcaagtgattttattgttgatattggaccgggtgcaggagtgcatggtggtgaagtaattgtagctggaacgccacaagaagtaatggattgtaaaaagtcaattacggggcagtatttatcaggtcgtttaaagattgatgtgcctaaaaaacgccgtaaaggaaatggtaattttattcaagtaaaaggtgctgctgcaaataacttaaagaatatcaatgttaagtttccattagggtgtatgtctgtggttacaggggtttctggtagtggtaaaagtactcttgtaaatgaaatcatgggtaaagcaatgatggcaagaatttatcgctcgaaagaaaagcccggtaaacataaggatattttaggattagaaaatattgataaagttattgaggtgagccaagatccaattgggagaacaccacgttccaatccggtaacttatacaggagtgtttgatgatatccgtgatttatttgcccaaacaaatgaggctaaaatgcgtggctacgataaaggacgttttagtttcaatgttaaaggtggacggtgtgaagcttgtcaaggtgatgggttaaaacgtatttcaatgcactttttaccagatgtttatgttccttgtgaacaatgtggcggtaaacgctataatgaagaaacattgcaagttacttataaagataagaatatttatgatgttttagagatgactattgaagatgcagtggagttctttggaaacttgccaaagatcaaaactaaattacagactttaaatgatgttggactaggctatattaagcttggtcaaagtgcaacaactttatctggtggggaagctcagcgggttaagctagcaagtgaattacaaaaaaaagcaactgggaaaacagtttatattttagatgaaccaacaactggtctacatagcaatgatgttgctaaattaatagaggtattacaaagaattgttgatcaaggggatacagtcattataattgaacataatcttgacgttattaaggtagctgattatattgttgatttaggtcctgaaggtggcgatggtggtggtacgatcgttgtagctggaacaccagaaaaagtcgctaaatgtgaagcaagttatactggaagttttttaaagaagatgttatagggaggaaacaatgatgccaaagtcaattacagtaggtgaattattaaacaatgagcattatgttcaggtaactggagatgagaaatctttagagcggccaatttatgtggctgagatcaatcgacctggatttgaattagcaggattttttaaacacagcgattttcgacgaattataatttttggagataaagagtctgcatttattaatgagatgtcggaagaaagacaacgtgaaatattccctttcttaattaacgatgaagtaccatgtatcattgttgctaaaggaaatgaatgtccagcaatcttaattgagattgctcgaaaaaaagattttccaatttttattaccgaatcagcaacaggacgtgtttcaattgaattaacaaatattcttgacgaagcactggcaccggaaacactgattcatggagtctttttgaatatttacggtaaaggtgttattatcaaaggtgatagtggtatcggtaaatctgagattgctctagaattagtaaaaagaggacatttattagttgctgatgatgctgttgaattatatcatttaggacaaagtattgtggggaaagccccagaagtattaactaatttattagaaattcgtggaattggtgttattgatgtatcaaagatgtttggaattagctcaattctcgataaagataaagttgatttaattattcaattagatcgttgggtaccatctcgtgaatatacacgagtaggggttgaagaaaatgattcaactgaagaaatcttaggtgttaagattcctaaaattgttgtacctgtatcaagtggacgtagtatgtcagtaattatcgaagctgccgtaatgaatatgcgtttacgtgaatacggtgttgattctagcaaagaattcgttgatcgtattttgaagaatatcgataagaataaggggtaagttatgactttttttccagatggtaagacattcgttcaaatcggttctttttccattgcttggtatgcaatttgtattattaccggagcttttattgcatataaactaggacaatataatttcaaaaaaatcggttataataaagagattctttcagactatttctttggtttaatgattactggagttttaggagcccgattatggtatgtaatctttatgtggaacgaattatatgctgaaaatccacttgagatcattatgtttcgtcatggtggtttagcgattcaaggtgggatttttgttggcttgatttttagctggtggtattttaagaaacataaaattgatttcatggttgcagctgatgcaattatgccaggtgttttaattgctcaggcactgggacggtggggaaactttttcaaccaggaagcatatggtggaatggttagtctagatttccttaaatcattgcatttaccaaactttattattgaaggaatgcatatcaatggatattactatcatccaacctttttatatgagtctattgctaatatcgtaggatttttattaatctattttgtgattaggaagatccaaacaaaacaaggtgaacaattctttagttattttatttggtatggaatctttagattctttattgaaggacttcgtactgatagcttatatgtaatgggtctacggacggcacaattagtttccattgtttttgtaatcgttggaattgcaggatatatatattgtaaaaaatatggtaaaccggcgataaaagcgtaatctaaattaggtagttaaagtgaatagcactgagctgccttttttttaatttaataaagtgtgtctatttctattagttataacatagatatattatgtttttattactatttatagaaactgaattgtttctctagtataatataggggaaattagtaatttaaatagattttattataggtgggaggaaaacaaaatgaaattaaaatatgatgttggagataaaccattatgggctcaattattcgatattcttttagatagaattgtttcaaaagaatataatgctggtgataaaatgccaacagatctagaaataatgcaggaatttgatgtttctcgaatgactgttcgtcaagctatgaataaattgattaatgaaggctatatagagcgacgaagaggaaaagggacgattgttttagaaaaggaaaacaaagtagagactattctaaaatcttcatttaatggtgtgttagaaaaaaatgatataaagaatcgtcgggttttaaatgttgaaatggtaaatgctggtcaagaaattgcagatttttttaatattacaactaaagataaagtattacgattagttagagaaatccgtattaataatatggttgtttcaattcacgagacttttttaaatcctattgtccctttagatgaacagggagattatagtggttctctgtatgaaaaacttatgggtgcagggtatggaattagtaatgtaaaggaaaaaataagtgctagattaatgaatcaaaaacagaaagaactatttgaaattaaaggtgatgaagcaatgattaataggcaaaggcgaggattttgtcatgactttccagttgagtttactaattctatgtatctttcacaagggtatgaattaattattgatttatgtgagtagggatgtgtcattttgacacattttttattttagctaaatatattgacataataaataaagtatattatcataatggcataaagttataacatttattgaagaggaggaagagaaatggataagttcagcaagtttttggaagaaaagctaatgccaattgggcagaaaattaataacattagatttcttcaagttattagaatggcaatgatgccgttaataccatttattattgccgggtcatttacattaattgtattaaatttcccatttattgataaggttttaccagcgggctttttagaaatgctgggaaatgttttatcaccattatcagggacaactttaagtttagtggcaatgtttttagcatttttaatggggtataactatgctaaaacagaagaacaaaaatgtgaggaagtatacgcgggaattacaactttagtagcttttttgattgtttcaccattatcaataacagtgggtgaagaagttatcggaggagttattccaactacttatatgggttcacaaggaatgtttgtggcattgattttatgttacttggtggccaaagtttattgcaagattttaagtagtaaactaaaaataaggttaccggatagtgtaccaccaatggtatcaagttcttttgaatcgttaattcctgtaattattacattagttttagtttgcagtatcaattattgttttactttaacatcatttggcaatattcatgctctagtcaatgaaattattcaaaaaccacttttattaattggtactggattaccagcgttattgatttctcaaggtcttgctcagttgctttggttttttggattacatggagatcaaattgttggttccgtaatggatccaattcttcaaacagcaggaatggaaaatttgagcgcttatactgctggtgatgctgttccatatataattactgatcaatttagagcattatttgttatgattgcttttatgtcattagttattgcaatcttaatcgtatcaaaaagcaaccgattaaaaggagttggaaaggtagcagttttaccagcaactttttgtatttcagaacccgtagtatttggagcaccggtggtcatgaatgcaatgctatttattccatgggttttatcaagaccagtgtttggtctgataacctggctatttatgaaatttggattatgtccatatccaacgggagtagcaataccatggacaacaccaccagttttatcaggatttttagcaactaactcgatcatgggaacagttgtacaaataatttgtctagcaataggagttttgatgttcattccatttgttaaaatgattgacaaaacgtatcatcaagaagaaattaaaacgaaggagcaataaaatgaaaaagttatatagattaccagaaggatttaaatttggaagttctgcttccgcttggcaaacagagggatggacagggaaaaaagaacatcaacgtaattttgtcgatatgatgtatttagctgaaccagaaagatggtttaatggagttggaacaatcaagtctacagacttttataatcgttatgaagaagatattaaattaatgaaagaattaggaattcaagtatatcggacttcaatagattggtcacgctttattacagattatgaaactaatgaagttgatcaagatgcattaagattttatgaaaaggtaattgattgtttaattgaaaatggaattgagccaatgctttgtttagaacactgggaaattcctgagtatgttattaataagtatgggacatgggataatcgtaaggttatggaattgtttgtaggttatagtaaaaaagtaatggcggcttttcatgataagattaaatattggtggactattaatgaacctgcggtagttcctaacgaagcatatttatttggaaatatttggccttatgaagagaatactaaaaaatcagtacaaatgaattatcatcgtgttcttgcaacttctttattagtcgagcaccatgcaaaaatgggttatcagggaaaagtaggaataatcttaaatccgtcaccatcttatccaaaaagtatgaataatcctaaagatattgaagcagcaaaaatttgtgatatgtttaattataaacaatatactgaccctttgataaatggaaagtttgatgaagcatattttgaattattaaaaaaacatgagtgtatgtttgaatatgttaaaggtgattttgaaaagattgatgataataaaatagaagttgttggaatcaactattatcagccgttacgggttcgacaaagagaaacggcatggaatccagataaaccatttattccaactgcatattatgaaacatatagtccacgaggaattaaaatgaatttttcaagaggatgggaaatttatcctaaaggaatttatgatatgctgaagatcattcaaaatgattatcgaaatattgaatgttggattactgaaaatggtatgggagtaatggatgaagataagtttaaggatgctagcgggcaaattcaggacagctatcgaattgaatttttaagtgaccatatggcttggatgttaaaagcaattgacgaaggttgtgattgtcggggctttttgaattggacgtttacagataatctttcacctgttaatgcatttagaaatcgttatgggtttgtggaaattgatatggaaaataatcggaatcggagaattaaaaaatcaggcgattgggtaaaagaattaatgagaacacgatgttttgaagctgaagatacagaacctgagtataaataagattgagtaggaggcaaaaagcaaatgagtaattatgataatagcccctatatcaaaataaatggctatgacaacgatgcatattctggatatgcgcagattgataagaaaattaaagaatctttaggaaataaaaagatagttgttgtagattgttatttgggaattaatgatcgtgaattattaaatgtattgataaaaaaattgactccagcacacgtaattttaagtgaagatatcttttatgatggtaaaaaattgacagaaatgatgcaggtgaatctaactgaagatcgtgttaggggagtaatgtattatggaactattagagattatgttgatgaagctaagctggctaagatacaaaagtttgttaaaaataaagaaggaatagttcttgtatacggttttggggcaagtctaattactaaaggtgatttattaatatatgcagacctaacacgatgggaaattcaattaagatatcgggctggattacctaattttaaacaaagtaattatgatgaagatcctctaataaaaaataagcgtggttattttattgagtggcgaattgccgataagcataaacgagagatttttgaagatattgatttatatctagacactaattgcagtaataaacctaaaatgattactggtattgcgtttcgaaatgcattaagaagtgtttgcaatcaaccatttcgtctagtaccatattttgatccaggggtttggggaggacaatggatgaaagaggtttgtaatttagataaaagtaaatctaattatgcttggagttttgatggggttccagaggagaatagtattaatttgaagtttggcgatattgttattgcaaccccagctttaaatgttgttatgtatcaagctatagagcttttaggagcaaaaaattatgctcgttttggggcagagtttccaattagatttgatcttcttgatacaatgggtggaggaaatttaagcttacaagtacacccaacaactgaatatatcaagagccattttggaatgccttatacgcaagatgaaagctactatatccttgattgtgatggaggtggagtatatttaggtttaaaagagaatattaattcagacgaatttattaacgatttagaaagagctaatgagggtaatcaaagttttgatgccgataagtatattaatttttttccagcaaaaaagcatgatcatttcttaattccagcaggaacaattcattgttcttcggctaattgtgtagtcttggaagtaagtgctacaccatatatttttacttttaaattatgggattgggatcgtgtaggattagatggtaaaccacgcccgattcatgttgaagatggaaagaaggtaattgattatcaaagaacaactacttgggtagaatccaatttggtaaataattttacagaaattgaaaagagtgatgaatatacagaagttaaaaccggattacatgaattagaatttattgaaacacgagttattacaactaaacaaaagatttatcaacaaactaataaaagtgtggtaatgatgaatttagttgctggggaaagtgcagtaattaaaagtcctaaaaataagtttgagccatatacagtgcattatgcggaaacttttattgtaccagctcaagtaggtgagtttactattgaaccgtttgataaaaatgaaataaaagtattaaaagcatatgttagaaactgatttaattaaagaaatagaattcaaaatgatatgttccttgtttacttaagcggagcatattaaaatagaattctatttttttaattatttctctttaaattgacaaaaaaagtagtaaatatcgtataaataagtaattattcttgttgacagatagtctttatcatgattattataagtatcatggtcttaattataaaaagaatttttgatcgaacgatttagttataataaattatgttggaataacggagggattatgaagactagagtttttgggattttacaaaggattggtcgcagttttatgctgccgattgcagtattgccaattgcgggtttatttctgggaattggtagttcattgactaatgaaacaactatttcttcactacatttagagggagttttaggaaacgggacttttttacatgactttttaataatcttaactaaagtggggagtggcctttttaacaatcttccacttatttttgctgctgcagtagcgttgggaatggcgaaaaaggcgaaagaagtagccgttttatcttcaattattgccttttttgttatgcatacaacaattagcgggatgctttcattaaatggaagtattttagataatcaaataattaatcctgatgttttagatggaacgattacagcggtttgtgggatcatgtcattggaaatgggggtatttggtggaataatcgtcggtcttggcgttagttatatacataatcgcttttatcaaattgaattaccaagagcgttatctttttttgaaggagaacggtttattccgataatttcaacaataacttttttgtttgtgggaatcgtaatgttttatgtttggccattctttcaaaatggtatatatgaattaggtaaacttatctcaacctcaggctattttggaacctttgtttacggtgtaattaaacggttactggttccttttggcttacatcatgtattttatttaccattttggcaaactgcaattggaggttcaatggtcgtcaatggggcggtaatttatggtggtcagaatattttcttcgcacagttagctgatccaaatattgtgcattttagtagcgaggctacaaaatattttactggtgaatttatttttatgatttttggtttaccgggagcagcattggcaatgtatcagactgctaagccgaaaaataaaaaagcgattggaagtttgttgttctcagcggctttaacaagcatcttaacgggaataacggaaccaatcgaatttacttttttgtttgctgctccactgttatttggggtacaagttatcttagcaggaagtgcttatatggttgctcatatttttaatattgccgtgggattgaccttttctggaggtttatttgactttattgtttttggtgtattgcaaggtaatagtaagactagctgggtattgcttatccctattggaataatttatttcatgctctattattttagttttaaatatctaattaaaaaatttgatttgaagactccaggtagagagatagataatatgaagttatctatctttaagaaccctaaagcaagtcatcgaaaattgttaaataaaggaattgaaattgacaaacagtcacaattgattgttcgagggctaggtggtcgtgataattttactgacttagattgttgtattaccagattacgagcaacagttagtgataatcaattagtaaatgaaggtttattgaaacaatcgggggcagcggcagttgttatgcaaggaaatggagttcagataatttatggtcctaaagcatcatcgatcaaatcaaagctggacgagtatttaataaatattcctgatgaattagatgattatcaactggaaaaagagactgatcatactaatcttgaattaggcaatattgttgatggtgaggttttgccaattgaacaggctccagatcaaattttttcacataagctgttaggtgatggggttatgatcaagccatttcacggtttgatcgttgccccttgtgatggtgagataacaatgatctatccaacaaaacatgcaattggaatgaaattagataacggatatgaattgttgattcattttggaactgatacagttaatttaaatggaactggttttgaaatattagttaaattaaatcaaagagtgcaaaaaggtgatttaatttggaatgcagatttagagtatattaaagaaaatgctttagatgaaagtattttgttaatatttacaaatctatcaaatgatttaaagattgaaaaagaatatggtaaaataaagagcgggagtacaattatgaagatttgcaactaggagagggaaaataaatatgtataagatcattaaagtattaaataataatactattttagcttgtaatgagactgaagaagttattattatgtataaaggaattggattttcaaagaaagtggatgattattttgaagtaccacggaatgctaaaaaatttcttatgcaaaagggatataaagctaaaagtggttcaaatgatataatcaattatattgatccagtttatttagaaatagcatcagagattattagactgataatagagaaatttggaaaaattgataatgatatcttattaccattagcggatcatatctattttgcaataaagcgaatggatgaaaatataatgcctttaaatccatttatcaatgatattcgtttgctgtttcctgatgaatatgaggttgcattagaaggacgggaagtaattaataagtttatatcacgaatgatcaatgatgatgaagttggctttattacactacatattcattcagcaatttcttctaatcaagttgctgagtcaatggaggcaacacgaattattcatgaaagtattattaaattagaaaatgatcttaatattgttattgatattcaatcagtttcatatgctcgattaatgaatcatattaaatttttaattttaagattaaataaaaatgaagaattgcagatggatataagtgaatttactaaagataagtttccttttgcatatgaacaggcaagtaacatgtgtgaagcattatcaaaggttttaaaaaagaaattaccagagacagaagtaggatatctggcattacatttggaaagaatattgtcaagtatttaaaaatatattattttgaaataataatttttaaatgatttcttgacagaaaaggcttacaatgataatattgtttcataaattgaatattttatagtgtgtaactgataaagcaggcattaactatttaaaaaaagaacaaagatggtatttttgtatcttttaataatagtttgcctgtttttttgcgttataaagtatttaaaagaaagggaggaatttataatggtaggaattattcttgctagtcatggtgagtttgctaacgggattctacaatccggggcaatgatctttggagatcaagtcgatgtaaaagcagttactttgcaaccaagtgaaggacctgatgatcttaaagcaaaaatggaagcggcaatagctacttttgaaaaccaagacgaagtactatttttagttgatttatggggtggtacaccatttaatcaggctaatggattaattgctggtcatgaagataagtgggcaatcgttacgggtttaaatttaccaatgctgattgagacttatgcttctagaatgtcgatggaaacagcgcatgaaattgctaaacatgttactgaagttgctagagaaggggtaaaagtaaaacctgaagaattagaaccagaaacgaaagtagcggctcaagctattaatacacagtcacaaggagctattcctgagggaactgtattagggaatggacatattaaatatgttctggcacgaattgacacgcgtttattgcatggtcaagttgcaactacttggactaaaacaacacaaccaaatcgaatcatcgttgtttctgatgctgtttcaaaagataaattacggaaacagatgattgaacaagccgcgccaccaggagttaaggctaatgttgttccaattgataaaatgattcaagtggctaaagatccacgttttggtaataccaaagcaatgttattatttgaaacacctcaagatgcattacgggcaatcgaaggcggtgtagatattaaagaattaaatattggttcaatggctcattcaattggtaaagtggtagtaaataaagctattgcaatggggccggaagatattgaaacaattgaaaaaattaaagctaaaggaattacttttaatgttcgtaaagtaccaagtgattcaaatgaaaatattgatacgcttttaaagaaagcaaaagcagaattgaaaaatgtttaaaaataaaatgtagggaggaattataatgtctttaattacaataatcttaattattataattgccttactagcggggatggaaggaattctggatgagttccaatttcaccaaccgttagtggcatgtactttaatcggtttagtaagtggtcacttaactgaagggattattctaggtggttcgcttcaaatgattgcattagggtgggccaatgtaggagctgctgtagcaccagatgcagcattagcttctgtagcttcatcaattattatggtattaggtttagaaggtggagcaactgatgtgcaaacagctatttctactgcaatcgcagttgcaatccctttatcagtagcaggtttattcttaacaatgatctgtcgtactcttacaatcccaattgttcactttatggatggggcagccgaacaaggaaatatgcgtgcaatcgacatgtggcaaattttagcaatcttattacaaggaattcgaattgcaattcctgctgcagcactttgtgttgttcctgcggcagttgtaactgatgcattaaatcaaatgccaccatggctatctggcggaatgactgttggtggtggaatggtagcggcagttggttatgcaatggtaatcaatatgatgtctactaaagaaacatggccattctttgcattaggttttgttcttgctgcaatcggtgaattaacattgatcgcattaggagcaattggtgttgctttagcaatcatctatttaggattaaaagaaaacagtggctctaatggtggcggttcaacaggttctggagatccattaggcgatatcttaaatgactattaaaatcttgaaggaggaaagaaattatggcagaaaaaattaaattatcaaaaaaagatcgtatgtctgttgcttggcgtcatcagttccttcaaggttcttggaactatgaacgtatgcaaaatggtggttggtgttattcaattatcccagcaatcaaaaaattatatccaaataaggaagataaagtagcggctttaaaaagacatatggaattttacaatactcatccatatgtatcagcaccagtcatgggtgttacattagcattagaagaggaacgtgctaatggagcagaaatcaatgatactgcaatccaaggtgtaaaagttgggatgatgggtcctttagctggggttggagatcctgtcttctggtttactcttagaccaattttaggagcattaggtgcttctctagcattaagtggtaatattattggtccattaatctttttctttgcatggaatatcattcgtatcgcatttttgtggtatacacaagaatttggatataaagttggtacttcaattgcacaagacttatctggtggattattaggtaaaattactcaaggtgcttcaattcttgggatgttcattatcggatcattagtacaacgttgggtaagtattacttttactccggttgtatcaactgttacgcagtcaaagggcgcatatattgattggaatagtttgccttctggtgtagacgggatcaaatcagcattagaacagtttgcatcattaggatctaatggtttaaatgttgagaaagttacgaccctacaacaaaatttagatcaacttattccaggtttatcagcattattattaacattattatgctgttggctattgaaaaagaaagtatcaccaatcgttattatcgttgctttattcattatcggaattcttgcacgtcttggtggaataatgtaatataataaagaaaatacatggcagctgtaaaggaggaaatatatggtacaatctttaaatactaaagtagatttaacagtcaaagcaacttcttatcttggtcttgctaattacggagaagtcatggtaggcgataaagcatttgaattctataatgaaaaaaatattagagattatattcaaattccatgggaagaagttaattgtgtaatggcttcagttatgtttaaaggaaaatggattcctcgctttgccgttgttaccaaaaataatgggaattttactttctcatcacgcgataataaagcattattacgtgctattaataaatatattccctcagaaaatttagttcgatcacttagtttttttcaagtaatcaagcgagggttgaaatcattgtttagaaaaaaatctagacaataagaaaaagagtcagttaactaaaattagttgattggctcttttattcaaattacttttaaataatttaattagagatggcaaaataagattacttttttatacaatataatttagtttagttagagtttataaaactgatatactatatagtagtgaggtgataggctatgtttcatattcttgttgttgatgacgataaaaatactcgccaattgatcaaggctgttttagaaacagaaaattatattgttataggtgcaactgatggcgaagatgctttaaaggttttggatagaagtcatattgatttggtaattttagatgtaatgatgcccaaaatggatggttatgagtttactgaaatattacgtagagtacaaaatgaactacctattttaatggtttcagcaaaacaattacctgctgatcgaaataagggatttatagttggaacagatgattttatgaccaagccgtttgacgaagaggaattactcttacgtgttaaggcattattacggcgggctaagattgtaaatgagcatcgaattataattggtgaagttattttagattatgattcactaacagtgaagcgaaaaaatacctgtcaggaattaccccaaaaagaatttatgcttttatataagctgctttcatatccgggtaaaattttcacgcgaatacaattaatggatgaaatatggggtgttgatagcgatactggatgggaaactgtcacggttcatgtcgctcgattgcgaaaacgatttgaagattggccagagtttgaaattatctcagttagaggacttggctataaggcggtaagaaatgatgaatcgtaaaaaagcaccgccacgagcattactaactttaatatttacgattgtagtatttataattttagtagttactatgataatcgttggatgtgtaatatttttcttaacacaaatcggtgtattaggaatatcacaaactgcatcggctccaattcattttcaaattattatctttgcaatgacaagtattgttattgggacaatagttgcagcacttgggagtcactttccactcagaccattaaatacattaattgaagcaatgaatcagttagctcatggaaaatatgatattcgcattaatttagggaagcaccgtatttcacaggaattaacagacagttttaatacaatggctgaggaactagaaaatactgaaatgttacgaactaattttattaatgatttttcacatgaatttaagacaccgattgtatcaattaaaggatttgccaaattattacaaaaagataatcttgatcaaaaaacgcatgataaatatttacaaattattgaaactgaatctagtcgtttagcagatatggctactaatgtattaaatctaaataagattgaaaaacagacaatactaagtaatattactagtttcaatttatcggagcaaattcgtaattgccttcttttattagaaaagaaatggtctaataaaaatttgaatctaattattgattttgatgaacatcaaatagctgggaatcaagagttattgtatcaagtatggattaatttacttgataatgcaattaagtttgccccaagagatggtaaattaggaattaaaattattcataatcaaagtgattatcaaatcttaattagcaataatggacctaaaattactgatgaagagaaaaaatatctttataataaattttatcaaggagatacttcacatgctactgagggaacaggaatcgggcttgctatcgttaagaaaattgttagtcttcatagtggtactatcgatgttgatagcaataaaaatgaaacaacttttattgtaacattgcctctcaatttgtaatacaaatacatatgcaaagaactaacgagattaaagttagttcttttagtttagttttggtttatttttattgtttaagatggacttataaagcgaaaggagattttgaatgataaaaatatttaaaaactttactaaaaaagattggagcttaattattatctgtctagcatttattattttacaagtatggttagatcttaaactcccagattatatgtcaaaaataacaatgctagtccaaacaacaggaagtacaatggatgaaataattgagtcaggtgtaaagatgttaggatgtgcattaggaagtttagcttcatcggtagttgtagcaatctttgcagcaagggtagctacaaattttgctgctaatttaagagagcgattgtttgataaagtacaagctttttcaatggaagaaattggtagtttctcaacagcaagtctgattacacgttcaactaatgatatttcacaaattcaaacacttgttgtaatgggattacaagctattattaaggcaccgattatggctgtttgggcaattttcaagattgctggtaaaagctggcaatggacagcttcaacgggtgtagctgtaatcgttttattagttattgtaggaagttgcatgatttttgcattaccaaaatttaaaaaattacaacagttgacagatgatttgaatcgggttactcgtgaaaatttaacgggaataagtgttgttcgggcttataatgctgagaattatcaagagaataaatttgaaaatgccaatcaggagttaacctcagcaaacttgtttgcaaaccgagttatggcaatcatgagtccaggaattcaaggaatcatgagtggtctgacattggccatttattggattggagccatcctgattgaaaatgctgctatgatggataaactaaacttattttcagatatggtggtattttctacatatgcaatgcaagtagttatggcttttatgatgcttgttatgatttttataatgtttccaagagcatcggtttcatcaaagcgaatcatggaagtattagaaacagtaccaataattaatgatggtacagtaactgtcgctaaaccgggtattaaaggacaaattgaatttaaaaatgtcagttttaaatatcctgatgctgaagattatgttttacaaaatattacttttactgttgctcaaggagaaacagttgcttttatcggttcaactggatgcggtaaaagtacagtgattaatctagttccacgtttttatgatgtaacagaaggtgaagtactcgtagatgggattaatgttaaagcttatacacaatatgccttacataacaaaatcggttatgtatcccaaaaagcagttctttttagtggaactattgaatctaatgttgcctatggtgataatggtagaaataataatcttcaaaacgatgtcattgatgccatttatacagctcaagcttctgattttgttgaggcttcaccacgccgatataatagctatgttgcccaaggcggttctaattactcaggtgggcaaaagcaacggatttctattgcccgggcaatatgtcgtcaacccgaaattatgatttttgatgattcgttttctgcactagactataaaacagatcaaaaacttcgagaagctttaaagaaagattgttgcgatgctaccaaattgatcgttgctcaacgaattggtacgattcgagatgctgataaaattattgttcttgatgaaggggttattgtagggatgggaacacatgaagacttaatgaagaattgtcaagtttaccaacaaatagctcgttcacagttatcaaaggaggaattagaataatggcagaaggaaagtatttagagaaaaatgatttaaaagctcctggggttaatatgggtagtaaagaaaaatctaaagattttaaggaaacatggttaaaattgttaaaatattgtagaaagtattggattgtaatggttatggcaattatcagtgccatatttggaacaatattaaccttgataggtccagacagattatcagaattaacagatttaattacaaatggaataatgacgggaattgatatgacaaggattggtaaaattggtcttacattagtcggattttatgttactagtgcttttttttctttatttcagggatttgtcatggcaacagtaactcagtgggttactaaaaatttaagaagagatatttcgcgtaaaattaatcgcttgccaattagtttttataatcatacttcaactggtgatatattatcgagagttaccaacgatattgatatgattggacaatcattaaatcagagtgttggaacattagtttcatcagtcactttattagctggttcacttataatgatgttaaaaactaatctcattatgacttttactgcagttctagcaacggttataggttttgctttaatgctggtaattatgtctaaatcgcaaaaatattttgctcgccagcaaaaacatcttggtgaaatcaatggatatgttgaagaaatttatactggtcatacgattgttaaggcttataatggtgaagttaaggcaaaagaagcttttacaagacagaataataatttacgtaatagtggttttaaggcccaatgcttatctggattaatgatgccaatcatgagttttattggtaactttggatacgtagcagtatgcattattggcgctgcattagcaatgagtggagatatatcatttggagtaattgtagcatttatgatgtatattagatattttactcagccattatcacagttagctcaagcagctcaatcattacagtcagcggctgcagcaggagagcgtgtatttgaatttttagaagctcaagaaatggctgatgagagtcataaagtaaaacgcttgtccaaagccaaaggtggagtagaatttagacatgttcattttggttatgatagcaataagattattattaatgatttttctgctcgtgctgaacctggtcaaaagattgctattgttgggccaactggagctggtaaaacaacgataatcaacttattgatgcgtttttacgaagttgatcgtggcgaaattagaattgataatattccaactaaagatttacgtcgagaagatgtccacggacaattctgtatggttcttcaagatacgtggctttttgaaggaacagtgcgtgagaatttggtttataatactaaaaatatatctaatcagataattgaagaagcatgtaaagcagtaggtttagatcattttatcagaacacttccatatggttatgatacggtacttaatgatcaagtaaatttatcacaaggacaaaaacaacagttgacgattgctcgagcgatgattgctgataaaccaatgttgattcttgatgaagctactagttcagtagatactagaacagagttacagattcaaaaggccatggatgaattaatggagggacgaacttcctttgttattgcgcatcgtctttcaacaattaaaaacgcagatttaattctagtaatgaaagatggtgatattattgaaagtggaaatcatgaagatttattaagtcgtggtggtttctatgcagagctttataatagtcagtttgataaagctgtataaattattgattttcttataaatttagtgttaagaataattatataatagaatgatttgatagaaatattataaaaaatataatgaaaacgaaggaaaaattcccttcgttttcattatattattttttactctgcttcaattaaaccaaaacgaacaaaagcattatacaaaccgtcttggtcgacatcatcagttatataatcagccatagctttgatttcatcgccaccacttcccatagcaacaccaatatggcaataatcaagcattggaatatctattttagcatcaccaaaggcatatgtgtcctcaatatctgcacctagatactctaataaagcatcaatagcatgagctttagtaatatctttaacgcctaaatcaccaaatagagcaatttcccctgcaccgccccatgtaccagcttttaaatcaggaaattcttcaattgaatcaagatgatcttgataactttcaagaataaaactaactttattcaaatcatcacgatataattcaccatcaaaaatcatttctggaaaaacatctcgaactttaatttgatcactatgttctttacctttacgtttactatattcttgaattactggttctccccgagtttcaaagttttcactcgcaaataaaccattattactttcaagatagaattcaagtcctcgactttttaaccagtctacgatatgtttacattgctcagcagtaattaactgatgcataacaaccgtatccccatcttctacataactgccattcccaccaatcatgccatcaagaccaatatcccataaataagggtatacctcagctttacttcgtccagtacatatatacacacgatgtccatttttacgtgcttgtttaattgctttgtctgctgaagctggcaatttgttttcataatcaactaaagttccatcaacatcaataaagataatttttgaatctgccatttttattttcctcttttctatatgatatgactatatctttattataaaagatatagtcatatttacaattcctcaaagagaagaagaaactattttatctataaattatagaaattagctaaatgaaaagataagtttctatcattttaattgtaaaagtaaaaataatttttataaataccaaaagtataaataaactataataaaataagaagtgataataacacacttcttactaatagtaatgaatttaaagggtaacttaaccttaaattattttatatttgttgccattggtttaattgctttatatgccaggagggtaacgaccgccccaataagtgcctcaacgataccattagtagtcacaacaccaaataacattgccagcaatgaactataggcaatattaactgcatcagcataagcagtgccaaagaaaaagtaaattccgcctaggacaagtacagtatttgtaatcgttccaattaaagcaccaatcactgctgcagcattttcattattaaacttgttttttataaattcaaagattactccagcaagatagccaagtaatattcttggaacaagagcaattataacgcttcgccaatccccgctaatgtttcccactgtaacgaatggtgaaaaacaaaatgatgtaattcccggctgaatcgttgcacgaattaaactagttagtccaaagaccaaaccaagttgggctcctgccttttttcctaatgtaatcccagcaatgattacaggaatgtgcattgtcgtagcacttaaaggaccgattgggatataaccaagcggtgttacgacaaggatgatttcaatagcaagaaacattgccatgaaagtcatgtactgtgtttttttagatctcattttttcctcctactatcactctttttagatgtgatgtttattatgagtgtctcgccatatcttcccatttttctaagagtcatgatgatctcttgaaaatatcttcttgatacggtttgacgataagattatagtacaatttattattgctgccaactgtaataataattatttatgtaattctttgtatgattttaaaccgtaggcgctgtcggctttttttaccgcacgattgactgctttagccattaaatcagttgcaagaatcccaatggcatctggcattacttcaacttcattagtacttaatacaaaaatagtatcgccatcactcatcgtgtggacaggctgaatagcacgggcataaccgttgtgggcaatccctgcaatctttgtacattgagctttgtttaatttggcatttgtaataatacaaccaatggtagtattaccacttggtaattggcgaagtttttcaatttgttgaaaaatcacctcgtctgcaggaatgatactgttgtgttctgaatcataaattccagctaactgttcattagttttatagtcaacaatatttccacaggcattaactgctacaattgctccaacttgaagattatcgatctggatggctgcagtacctaagccgcctttcattgcatattgtggacccatgattttaccaacactagcaccacatccggcaccatagttaccctctttaagcggttcatttttttcgctattaaggcaagcttgatatcccattgctttatctggacgaattttaggatcaccaactgttaaatcaaataaagatgcaccacaaacaatagggacatgggcgaccttcatatcaaaaccacagttatgttcttctaaatattgcattacaccactagccgcatctagtccaaaggcactgccgccacttagcattacagcattgatctgttggaccatgttgattggatttagcaggtctgtttctctagttgctgggccgccacctcttacatcaacaccagctgtagcaccatctttgcagatgattacagtgcagccggttccagctttttgattttcgacttggccgatttgaatgcctttaatttctgttatattaatttttttcatgttatcaccccaatttattgtacaacataattactattatttccttatattttgaagatgacaataatagttgctaaaaatgtaaattatagtttctcgaaaatttttaaatatatagtaaaatgatactaaaataaaggaggatggaaaatgattggagataaaattattttatatcgtaaacgtaaaggattaacacaagaggagcttgctgatctgcttgaagtaagtcgccaaacagtaactaaatgggagagtggtagtgtgctgccaaatctcgattatatcatgggattatcagtgatatttgggataacgattgataacttagttaaggataatgactgtgctaagcaggaaatagaaagtaaaattagtaattataactggattgattttatgttaaaggcaaaaaaagcaacctatgctaaaaaggaggggaaaactgtttccagtcgacctaacagccatgattatcaatatcaagaaaatgaatatttatatattgatacgtttgtaggcagtgaattttttggtggtgaagaatgtgtctataaagacaatattccactttatgtaatgaattattatggtaaagtgcttgatgaggcttttagtggtgattttttgaaggaagcactattattagttgatcgaatttctccttttagaggtccggcgttgtatactaatggtaattatacatatcattgtagttatgatggtgattatgaattttttaatggtaaagaggaaatatactataataatattaaagtatacgagtgtttattccatggcggaagtgttaaataattaaatgacatcaatcggttaattaatactggaataagaaaatgattttagaatattaattaggtgtttaaaacaggtatcagtagtggcagagaggaatttgcccatgatattttaaaaggttttgtttcagttaaatcaggatttctttccaataagcaggagtatttagatttatctaatattcatatttcaagagactaaaaaataggggaactagaaagactttttagcaataaaaatatttaaatgaggaaccctataattgtcaacttaactgaaaattataattaaaagatgtaacgtttaaaaatttatccgttacatcttttatattcattttatttaacttgttcaccaatccattgccaaactttttcaccatgttcatcacagtcggcttcattattatcaaaatagatccatgaccagtgaccattatattggtatgggtcaccatcatttaaatcattatatttaccagaagtatcgatgaccgaatcaaatgtggcaacgtgtagattagttgcaccaagattttttaatcggttaatagtaggaatttcaaatttttctggaataatactaggatcatcattagaataaataaaatatagaggtagatctttaatttcagaaagttgttggtcactaataacatcatcaggcagggcttcacaaattggtattgctgcagcaaaataatctggataatctaaaattaaacgcatagtcatatatccacctgcagaacatcctgcaagaacgactttagtagctccgcatcgagactgataatctttaattaattccataagtgcattagtataataagaaggaccatgagttactaataagtcatcattccattcaccgccattaccatcagcatccatccaaaaagttggacattgaggaactaaaacatatgcattgccaacagcattttggaaatcatcattaaaataagcacttactttatttgataaagaggttacttgtggattagtatcctctgttcccccttcaccagaaccatgtaaccacacaaataatgtattagaaggttctttagggttaaaatgaccataatttaattcaattccatcactagccttaaatttttctaattctaaagcgtcagcagcagtaatttttttagtatattctgtactaacatcaagtttagtaacttttttatcgtctaccgttatttcaccgttttttgctaatgaaatatttaaataatacggatcactccatgtattataatgtgttgtagcagagtataataatggcgaaccatcatttgggcttacatataactcaatcgcaatatatttagactctccatcaattttttgcccatctttatcacaagaataggcatcatcaacaacacgctccaaagttttttcaacaactgggagtgcctcatcttcccaatcagttacttgttttgtttcagataccataaaatcatttttgtcaacatcatcaacagctttgtctaatgtcaaaatagttttattgacgccacatccccaatcatatccggcaatataaatttcataagttgcatcaacaacttctgtgctttgagaacatccggtaatgctacaagcaataaataaggcaagtaataattttgataatcttttcattctctcttctcctttcaccttgcctatatcttaagcttatttataaaatttaaatatgaaaaaaatgaccacattagggtcattttctaactttattacgatatacttggggtgtttcatgatatttgagtttaaattcacgattaaaagatttagtactagagaagccatttttcatcgcaatctcagtaatggttaaattagtatgaaccaaatcgttagtacagtgttctaaacgttgtgcagttaagtattgtttgaccgtaatatttaagtgttttttgaacaatcttgctaaataaccataagagaagttaaattggttcgcgattgaggaaacatctagtgcttgagaataatgttcatctaaataaaagagaattttcataaattcttggagtttttgatcagattgaagaaagtaaccaacttttctaatctttttttgatactttaataaaatactaataattaaatataaataaccattaatagtaagtaatttaaattcagtagtttgttgatactctaaactcaaattagttaaaagaacgaccagtttttgttcaatttctgggactatatgattagaaaaatagatattatcaaatgcaggatagcatttttttagaaaatcatacttaatttgaataacaatacttttaaaacaatcctctgattcaataattttagtcgtatgtatagcttgtgaattaatgatagctaaaccattacgagcaattgaataagtttccccattactccaaagttcaattgatgcggtaagtggaataataaactctaaactacgatgccaatgttttggagggattaaattaggatcatctttagctaaagttacctcaataacttttagcggaagttcatcagtagtaattttttcataaattatatgcgtattattatctaataattcttttccattcaacatcctaccactccttttatattataataacataaaaaaattaattttattaatccaattcatttattttaatatataaaatagctaagatatttaaaccttagctatcatctctaatgcatattttttagcattttctaaatcatttgtatctggatgtgatagagctgcatcaaagttatcaatactaacttgaagctgtttatcttcaggatgctcttgaatcattttaacatagcgatcacgtattgataaaggcatcttaccgggacagaaaaagtgtcctaatatcttattattagtatttacaacattatcaaatcgttctgccagtttatcatagtattcagtagaaccaccaaatccagctgttgcaaaaaaagcgattttttcatttgaaagagtagtaagaaaattttgaatcttttgactacagttacccttatcggtccagcttccaataaaaatcagatctgcgtcactgaatgtttgaggttcaccgaagtaaacaacctcttcgttaatacaagcttctttaattacattagctacttttttggtattacctgtatgactatcaaatacaattgcaattttcattttaatcacctcgtcataagtatagacttatattcataaataataaagcataatctttatcacatttaattacgtgtgatatactatgatgtgtaaaggagattttatggatacagcaataatatttgatttagatggaacagttttatatacagatgaattaattaaaagaacttttattaaagtatttgaaaagtatcagcctgggtatactttgagtgaagatgaattattatcttttttaggaccatctttaaaagaaacgttttcgaagtactttccagatgaaatgtttaatgaattgttgaattattatcatagttataaccatagtcatcacgaggattttgtctatgtttatccgacagtagtagaaacattagaatatttaaaaaatagaggttatcctttaggaatcgttacgactaaattaaaagttgctgctgatgtaggactcaatacttttgatttaaaaaaatattttgatgtagtaattggattagacgatgttaaggtcactaagccggatccagaaggaataatcaaggcaatggaattattgggggttaaaaaagctgtatatatcggtgataatataactgatattcaagctgggaaaaatgctggtattaaaacaattggtgtaaaatggtcacctaaaggttatcaacatttattagaattagaaccagatttaatgatcgacgagatgaaggaaatcattccatatatagaaggagcgtgttaagatgaaagatttaattattattggagctggtcctgctggattaagtgcatgtttatatgcaactagggcaggggcagaggtgttgatgctggatgctggggcacctggaggaaagttgaatgtcagtgctgaaatcgaaaactggcctggacaaaaaaagaagactggccctgagttagcttatgaaatgtatgaacatgcattatcatttggcggtgaacaggcatatggtgaagtaactaaagtaattgattacggtgattataaagaagttataacaacggatcagtcatatgaagcaaaaaatgtcttgattgctactggaactaaggaacgtaaaatgggaattccgatggaagaagaattaaccgggcatggtgtttcttattgtgctgtttgtgatggaccattttttaaaggtgatgaagtagcagttgttggtgggggtaattcggcattagaagaagctatttatttaactaaatttgctaaaaaagtacatttaattgttcggcgggatgtttttagagctgataaaataattcaagatcatgttcaagctaatgataaaattgaaattcattttctaaaaaaacctcatcatcttattgcaaaagataataaggttgcggcgattgcattagaagatagtaagactggtgaagttagtgaattagcagttaagggtgtctttccatttgtaggattagatccaattactgattttgttaaagacttaggaattactgatgagcgtggctatatcattacaaatgaattgatggaaacatctgtcaaaggtatttatgctgctggtgatgttcgtcaaaaagtacttcgccaagttgtgacagctaccaatgatggtgcaattgttggtcaacaagttggtcaaggcttaaataattaataatttttgcaggtcttaataaaggcttgcatttttttatttatacttttatttttatgataacaaattgaaaaatcgcgttcaatactgatgttattgacattaataacttgaatacttttttcaataacttcattttcaataattttcataggcattaaggcgataccatgaccatttaaaactgcctgtttaacagattcccaactatgacattgccaagcaggctccaaaaaaatattattattttttaagcattcatcaagttgatttcttgtcccactaccttgttcacgatcaataaaaggatgtaaactcaattcagttaggctcattactttaacgttatttagagggtaatcttgggcacaaacaaaaacaactcgatctttgataacgggttcgacaattaaatcttgattgatgatcgtaccttcaactaaagcaatatctaaagtattatttaataatttttcttcaataacattagtattatcaatataaacttgaaaagtaatatcttgatatttatcttttaatttctttaaaataggtgaaataagagtactgccgattgtcaaagttgcaccaatctttaatgggaattgtttggttttagtaaagatatgttcaatttcatcatatagattcaatatctggttggctttaactagtaatgtttgaccctcttcactgataaatagtgtctttgaataacgttcaaataatttaacctgatactcatcttcaatttcttggattttttgagaaatagttggctgggagatgtataataatttggccgcttttgacattgatttagttttagcaaccgttttaaaaatggctaaatgttttcgtgtaatcattttgagacctcctgtgctattggaaaaaccaatagatatcattagatattaatattattataataacatagaaagtgttataatcaaaatgtaagcgtaggtattaggaggaaaaacgatgggatataaagtaggttttaaagatgtaaatgatattttggcgacgctatcacaagaatatgatatctatggaccaaaacgctttgaaaaacaagggcgttattcagatactgatattattcgctatgataaaattagtaaaattgaagaagtagtgtttgatcaaaaatctgattttccagctaaagaagtaattaccccaattactcaatctttattctattttacagaagatgaatatcgtgaaagtaaagtaactgataaaaagatattgatttttatgagaccttgcgatgttaatgcaatggaacatcaaaataaaatatatttaggaaatggcgggtacagtgatctttattatcaacgacttcaagaaaaagttaagataattttaatggagtgtataagtggctgggacacttgtttttgtgttagtatgcaagctaataaaacggacaattatagtctggcaattcgtcatttagataatgaggtattaatagaagttaaagaaagtgaatttgaaaaatattttatggaagcccctaaagatgattttgaagtttcatttattgaggaaaatgaagtaaaagtaacagttcctgaaatcaaggacaaggaaacgttattaaaattaaaacaacattcaatgtggcaaacatttaattcacgctgtatttcatgtggtgcttgcacgatagcatgtgctacttgtacatgttttacgacaacagacttaatttataatgaaaatgctagtattggagaacgccgaagaactgcagcttcatgccaggtcgatggttttagtgatatggcaggaggtcatgcctttaggccaacggctggggatcgaatgcgatataagattcttcataaatttcatgattataaagcacgttttaatgattatcatatgtgtgttggttgtgggcgctgtacatcaagatgccctgaatatatttcagtaacggcaacagttgagaagatggctacggcagtggcggaaattgaagtgaaaggagataaccatgaataatccaatcaaaccaattccaagtacaattcttgagataaaacgagaaagtaatttagagtatacgtttaaagttgctacaaatattaaaccggaacatggacagtttctccaattatcaattcctaaaattggtgaagcaccaatctctgtttcagcccagggtgagggctggttagattttacgattcgttcggttggaaaagtaactgatgaaatttttaataagaaacctggtgatgttctctttattaggggaccatatggtaaaggctggcctttagaagaaacctttaaaggaaaacatttagttgtaataactggtggtacaggattagcaccagtaagaagtatgctaaatgagtgctttgaaaatgatggatatgtaaaaagtttaactttaattgttgggtttaaaaatgaggcaggaattatttttaaagaggaattaaataaatggcaagaaaaatttaatactttctatactttagataaagaccaaattgaaggatggaatgttggttttgtaaccgatttagttgaaaaaattccttttgatagttttatgggtaattatgaagttattattgtcgggccaccgatgatgatgaaatttaccggagaaaaggttgctggtttaggggtacctgatgaaaaaatttgggtatcttttgaaagaaaaatgtcatgtgcagttgggaaatgtggacattgccgaattgatgaaacatatgtttgtttagatggaccagtatttaattatacaaaggctaaatatttagtagattaggagtagctgaagatgaatcatgatattgatataaaaaaattaagaataaattgttttagacagtctaaagtggctggtgaattcatgttacagatgcgggtgccaggatcaatgattgcggctaaatatttgcaagtagttcaagacatcgcagaaaactggggaaacggaacatttcatattggaatgcgacaaactttgaatattcccggaataaaatatgaatacattggtgaagtaaacaagtatattaaagattatattaaagaagtagaagtcgaaatgtgtgatgttgatatggatgttactgattatggctatcctactattggagctcgtaatgttatgagctgtattggtaatactcattgtatcaaagcaaatgtgaatacgtatcagttagcaagaaaaattgaaaaaattatttttcctagtcactatcatattaaagtatcagtatcgggatgccctaatgattgtggaaaaggtcattttaatgattttggaatcatggggatcgcgaagatggagtatcatccagaaagatgtattggctgtggtgcttgtgtgcgagcttgtcaacatcatgcgactagagtactttcactaaatgctgataataaagtagataaagatacttgttgttgtgttggatgtggagagtgtgttattgcttgtccaactggtgcctggacacgtaaaccaactaaattttatcgtgttactctaggtggacgtagtggaaaacagtatccaagaatggggaaaattttcttaaattggattaccgaagatgcattactacaagtgtttagcaattggcaaaagttttctgcctgggtgatggataacaaacctgaatatattcatggtggacacttaattgatattgctggatatcctaagtttaaagaattgattttagatggcgttgaattaaatcctgagtgtcttgtggcagaagaattgtattggactgaaagtgaacaacgtgccaatatccatttaaaaccgcttgaacaacataaaaaagcaggaccacaaaattaaaaccacgatttcgtggttttttaaaggtttatggagttcgcagtaattggtgttagccacaagcaattagcattggataaacgttccttatttagttttacagatactcaaaaattagaattttcaagtttattattaacctatggtattgaacaagttcttattttatcaacttgtaatcgaagtgaagtttatttgatgtatcaaacagatattgatttcttaccatctatttatttaaattattttaatcaagctgaggcgccattatatgttaaaactggtgatgaagcttttaggcatctactaaaagtaacctgtggattagaatcgatgctgattcgtgaagatcaaatattaggacaagttaagcaggcatatgattttacttgtagaatgtctttagggggaaaagagttatctttgatttttcaagaaactcttaattttgtcaaaaagatgaagcacaaatatcagcagccgtcaatctcattgactcatttagccgttgaacatttaaaaaaagtatcaaacttatataataaaaaaattatgatttgtggtgccggtgaaattgcgacatcatttatcccatatttatatgataataatgaattaattttttctaatcgaaatagtgacaaacttgttaaattaaaacaacagtatcctaaaataaaaattattccctttaatcaaagaaagatcttgttggatcaagttaatattttaataagtgctacagcgagcccgcatctaatctttaatcgtgatgattttataaattcacaattaatagcgattgatttgacgattcctcgtgatattgataaaactgcttctattcaatgtattgatttagatacattaaaccatgaggttgcagtcaataatcaattacgaagtaaagatgtagaaaaaataaattcagaaattgatattaagatcggggaagtaagaacaaagcttgatagtatcaaatatgattatgtgatacaatctttacaggcaaaaagtatgcagttagctaatcaaacctatgaaattttggttaataaactatctttaactgctcgtgagcgccatatattagaaaaaacattaaaagcatcatttatgcaaataatgaaagatccgatacattgtgtaaaaactaatcaaatcaatgatcttgaagtaataaataaactatttagtcttaaagaggataatgaagaatgaaaataattgttggtagcagaggctcaagtcttgcgttaaaacaaactgaatatgtaattgaaaaactccaaagggcatatccagaaaatgaatacgaaattaaagtcattcataccattggtgataaaatgcaacatattgctttggacaaaataaacgataaaggtgtttttgttaaagaaatcgaaaaagaactattagagcatacaattgatcttgctgtccatagtttaaaggatatgccaagtgataatcctgctggtttagtatacgctaaaacgttagctcctagtgattatcgtgattgcttagtattaaagaattgttcttcattagcaaggctgcctcagcatgcaacgattgcaacaggaagcaagcggagaaaatatcaactattaaaactccgtcctgatttaaaaatcgttgatattcgtggaaatgttaatactcgtctacaaaagatggcaaatcaagaaatcgatggtctagtacttgcaagtgctgggctaaaacgtttaggcttggaagatttaattagtgagtatttagatgagacaaaaatgattcctgcctgcggtcaaggcatattagcaattcaagttcgtcaagatagtgaattattgacgatgatcaataatataagtgatgaaattacaacaacacgaatggaactggaacgtttatttttaaaaacagtaaatggcagttgtcatattcccgttggcggttatgcaaaaattattggagatcaggtacatttttacggattgttagggaatgaagatggaacggttttaaaaaacattgataagaaatttagtttaaaagatgcaagcgaggaagtaacagcacttgctgaaatgttaatgagggaagtttatgaacggtagagtctatttagtcggtggtggtccaggagcaatcgatttatatacagttaaggcgctcgaatgtataaaaagtgctgactgtataatttatgatcggctaattgatcccgcaatattaaattattgtaaggaaacatgtgagaaaatctatgtgggtaaagcttcaaataaccatactttagctcaggataatattaatcttctgttaattgaaaaagctcgacaatatgcacaagtcgttcgattaaaaggtggcgatgtctatgtttttggtcgtggtggcgaagaggccttggctttattcaaagcaggaattgactttgaagttgttccgggtttaacttcagctgttgctggtttatgttatgcaggtattccaataacacatcgtggggtatcttctggatttatggtagtaacagctcaccataaaaataatcaagcttatgaatgggattatcaacagtttctagatgacagcttaacgtatatatttatgatgggacaacaaaaactagaacaaatcgttacaaatcttttggtggcaggaaaagataagactactccaattgctttaatttccaacgcaactcgaacagagcagcgaagtatttatggaacactagaaaatattatcgataaatttaaagatagttgtttgtgctcgcctatgttgattgttgttggtgcagtagtggcactgcatcatgaattagatttttttcaaagaaaaatactactaaacaaaaagatactggttgcatgtgttagtgatcaagaattgccaatcagtaagtatttcaaagaacagggggcggcagttaaacaggttcagttagggaaggtcaattacctgaattctcagcaaaaattagatttaaatcataaattaattgtttttaccagccaaaatggtattagaggattttttaattatttaaagatgcaaagagttgatcatcgtagtttgacaacagttcgttttgcttgtattggtgaaaagacagccaacttgttacaactatatggatattatagtgatttaattagtcctaaagcaaatagtgaagattttaataattatttaaaaaataaacggatggatagtgaagaaatgattattgttcgtgctaaggaacatagtaagataaaaaaacgagcagaagatcatgaattaattgtttatgaaaataaagaattaataattgttgaagaagagtcatatcatttagcctgttttacttgtgcttcatcagttgaacgtttagcaaaatatccaagtacttttaagattgctttgtcaattggaccaatgacgactcaggcgcttaaaaaatattatccgcatgtgaagattattgaagctaaagataatagttatgaaggaatgattgcgattataaaggagaatattaatgttttatagaggaagaagattacgtaataaaaaggtaccaagaaatttgatcaaagaaaatcgtttatcagtggagcaattaatcagcccaatatttgtggttgcaggaaataatattaaaaaagagatatcttcattagagggaatataccattattctattgaccgtcttaatgagataattaaagaattacagagagctggaattaatgcgtgcattctttttggaattcccgaacataaagatgaattagggactgaagcatacaatgatgatggaatcatccaaagagcaattagagaaatcaaaaaaatcgctccagaaatgtatgtgatcggtgatgtttgtatgtgtgaatatacagatcatggacattgcgggattttggatcgtgatggttgtgtgattaatgatgaaactttattatatttaggcaagattgcagtaagctatgctaaaagtggggtagatatggtagctccaagtgcaatgatggatggtgaaattcttgctataagaaaagcacttgatgaaacgggatttaaagatttaccaatcatgggttacagtgctaaatatgcttcctcttattatggaccattcagagcggctgctaatagtgctccttcatttggaaaccgttcaagttaccaaatggatatagctaatggtaatgaagcgatgcgagaaatacaagctgatatagatgaaggtgctgatattattatggtaaagccggcattagcttttctcgatgtaatcaaggaggcaaaacttagttttaatatgccaatctgcgcttataatgtcagtggtgaatatgcaatgcttaaaatggcagttaagcagggaataatgaaagaagcagtaatagaggaatcgttattagcaataaaacgagctggggctgatatgattatcacttactttgcacttgaattagctcaaaaatggcaaggtgatcatcatgactaatcaagaaatatttgaagaagcttgtcaatatattccaggtggtgtaaactcaccagtccgagcttttaaatcagttggtgagattccagtttttgcaaaaaaaggtgataaggcgcatttgtttggtgaagatggagttgaatatattgattatatttgttcttggggaccacttattttagggcataatcatccagtcgttcaaaatgcaattattgaagcgagtcagttaggaacaagctttggactaccaactaagttagaagtagcaatggctaaattgattgttgacagctatcaaggaattgaaatggtaagaatggttaattcaggaacagaagctacaatgagtgctttaagagtagctcgaggctttactggtcggaataaaattattaaatttgagggcaattatcacggacatagtgatggtttattagttaagactggttcaggagcattaacttttaatcttccaactagtccgggaattccccaggaaataatttctcaaacaataatctgcaaatataatgatttaagctctgtaatagcagcagtagaacaaaataaaaaagatattgccgcaattattttagagcctgttgcagccaatatgggaatagttccagcgactaaagagtttttaaccggattacgtacattatgtgatcaaaatggaattgttttgatctttgatgaagtaattacagggttccgtgtctcttatcatagctgtccagattatttaggagttattcccgatatggtttgttttggtaaaattattggaggtgggctgccagttggagcatacggcggaaaaaaagaaattatgagtttagtttcacctcaagggccggtttatcaagcaggaacgctatcaggtaatccattagctatgtctgttggtttagcacaattaagctatttaaataatcatcctgatgtttatgaatatataaacaaagcagcaaattatttagaaaatggaattaaaactattttatctacattatcattagattatcaggtgcatcgttgtcaaagtttattgacgctattttttaccaataaaccaattactacttttgaagatgttcagacttgtaatactgaaatgtatgctttgttttttagagaaatgttaagacagggaattttaattgctcctagtcaatttgaagcatggtttgtaagtgctgctcatagccaaattgatctcgacaatactttaaatgcaataaaaaaagcactggtgaaatgtcatgatgccttggttgattaattttaaagataaaacagttgttatagttggcggtggtgcggttgctagtcgtaaagcattgcagtttcttaaagaaggggctaaagtaaagataattgcttctcgcattgatagaaagctcgaggctttagaggtagaaaagtatctgacagattatcagcctaaatatcttcaaaatgctttttttgtttatattgcaactgatgatcgtgaattaaataaccagataattagagatgctgatgaattaggagtattgtgtgcttgtgctacttcaagtatggcatctttaaaggccatgaaggtagtagaaacggaaaatctgcttttaggtatatcaacaaaggggcagtatccagcctttactaaaaaattagcttatgaattagaacaatatgatgattatttatctgctttaagtaatattcgtaggctggttcttttaaataatttggtaaataaacatgatcgaaaacagttttttaagcagctgatgtattttgaaaaaacagaattagatatgttactaatgtttattttagaaaaagaaggacgtctattaatttttacagcacagtgtatgaatgtgattgattactttgctgaacaagtatctgcgatgtctctatgtttaaaggaaatagattttcaagataaattaaaaatattaatgatgttaaaaataaaatggcagattcagccaatggtcatttcatatggaaagatctatgataaaatatctaaaatgtgttcaccaaaagaagtagcagcaccactttttaacagtgagattcttttagaacaactttattctaataaagtaaaacgcttatttataattcatccacggagtaatagtaaactatttgatattcttagtaggtatggttcagtatgtgcgtttaatactaaaataataggtgaatatgaacaaatcattccttttgtattgttgccaggatatcattatcaaaatgacattttgaaggcaatagaaaatgttaaaggacagttaaccccagtattattagaggataaacaagttgtagcactactaacaaaagaaatttcaagacgttttggattagaaaaggttgctatatagttagtaatcttttctttttgggaataattaggttaaaatatatacaaaggaatgattagatgaaagattttggagagttaaaacaaaaaatacaagagtgtcgctattgtcaaagacaatttggatatgaacctcatcctgttgtctggggcaaacctaatgctaagatcatgcagattagtcaagccccttcattaaatgtccacaatactttaaaaccatttaatgatttaagtgggaaaaaacttcgtgaggagtggtatgatatagatgatgaaacattttatgatcaaaataatttctatattgcttctttggctcactgttatcctggtaaatctaaaagcggtggggatcgtttgccgccaaaatgctgtagtgaaaagtggttaaggcaagaaattgacatagttgataaccaaatttatatcatcattggtagttatgcagctaagaaaatatttcctaatcaaaactttgttgatttgatttttaatgatcaagtttttaatgggaaacctgcatatgttcttccgcatccttcaccattgaatcggcgctggtttaaaacatatccagaattcgaagctaaacgagttaaagaaatcagggcagtaataaagagtttagtttagatagggctatttcgattgaaaatagctttttattttagtaaaatggtagcagtatgaaaagaggtaagaaaaatgagtcaagaagaaatattaagttatattaatgatagtcttgtaattaatggttctttttattcaaatcagaatcttcctaatcaaattagtaatgcaatttatacttttggtgattataatgtttttgaaatccttgcatttattgatgctaccaaagaacaagatggcagccgaggaatgatcatcactccagcacaaatatattttaagtttggtcaggctgggataattgaatatcaaaagattatttctttaggattggaaaaacatcgtaatgattcaataatcaaagctattatcaaattagaggagataacatatacttttagtaaccagataatcgaccctgaagtattcgttacaatgttatcaaaaattactggtattgaaatagagatgatcatggatactcatgaaaaagtagagtattatacgaggattgtattaaatgatcttgaaaatgatgaatatgaagatattgtattaactccaactcaaaacaatagtatcaaagagttttataaggaattagagatggttcagcaattagctgatgaagattatcaatatgaattagaaaatatttgtaatcgagcacttgaattttttgatgtattagggttagatagtgatgaaattgatggtttattagaatgtcaaaatcaatttaatcaaaaaaatattgaagaagaacaaaagatagataatgctcagcagttttataatgatatgatgaataagtatcaacaaggtgatagtgagatgttcaaccgagttaagagtataatgtcatcaatgggaatagatgaaaatgatttagcagggaaaagtccagaagaaatcgaggattttttatgtggtaaatttggtatttcaaaaagtatgcttgaaaaactagcaggaaggtttaataaaggtacagtgaaacactgatttaatagcagtgtttcactgttttcataaaaagacctctttaacaagcaaatgctcattaaagaggaataattaagtttatttagttttaggtttattatcactgtttttattagcgatagtacgaacaacttcacctaaatcggcaccagttagatcttttaaaacttcaaacccattagcagcaacatcactaacaattttactaactttacttccgccatcaccgctaccgttatcaataacagtaatcttgtcgatttgttccattggtttggcaatttgtgccataatttctgggagacgttcaactaccattgacatcattgcggcctcaccatatttttccatggcttcggctaaacggtctttggcctcggcttcggcaattcccttagcttttaaagcttcggcttcagcttccccttgtgctcgaatagcttcggcttcagctttagcttctaataatttggcgtcagcgcgtgcctgagcttcgatttttaatgcttgagctcgagcttcggcttctttaatcgattttattttatttgcttcagcttgaacctcagtttcatattttttagcgtcagctggtttttttacagatgccactaattgttcttcaactacttgtgcttctttttttgctaattcaacattacgatcagcaacgattttattattttcaatttcttgaagcttgtatgaaacatcggcattggctttgattttatcttgttcggcacgatattgttccattcgaattgttttatcacgatcactttgagcaatttcagcttcagcttctaatttagctttttgcccctcgcgtactgcagcagcagttttaacttcggtatctcttgctctttcagcgctagcaatatcagcatctgcttttgattgggcgatttgagggattgcccggttttctaaatatcccccttgagtagcaatttttaatactgtatatgataacaaacgtaatcccatgttatctaattctcgtgtaatactgtcttcaattgagttttcgaatgcgacacgatcttcattaatttgttctacggttaatgtagaaacaattccccgaagtttaccttccaagatttgttcaactacagttttaatattttgagtagtacgatcagcattaccactgcaaaattgctcgactgcgattaatactttctctggattattgtcaactttaacaactgcagtaccagcaatatcaacaaaaattccttgttttgaaggtgcttcagtgatatcagtggtcattgaaacagcttctaatgaaatgatacaagatgtttcaagaaatggtacttgaataccccctttacccgttagaacacgtttctttaatccggtgataactaaagctttgtcagcaggaactcttttccagcatgtcaataaaataataataagtagtagaacaatagctacagcaataacaatagtcatgtgttctgtaaagaaattatctgaaatcattttttctccccttttctaaagtgttatggttttaagataatcactttgataattttgaatattttcaatggttacatcgtgagtataattatcagagtaatatactttgatttggcgatttgtataatcaaggtaaccataatatcccttattagaatctctttctttgatgaccataatgtcatcatatggcagttttaaataagcttgataataataatgtttaaataaaatttccgcatttgtttctaaaaaatcaatactatcaacattcatatagatatcaatatctgataaattagtgaagacatctaatgccggatcttcaaaattataaaatgcaatagtctctatagttaattcttcctcatcgataatggagcaataataagtatcattaggaacgattaaaacattatttgtatagccattgtcaagatacttgatatacaaataatactcagaatcattcctaatttctaataaatcatcattacctcttgtaacactaattaaatcaagataatttaagccatcttcaacataatttaaatatgtgatagcaacattgtaattttcattattttcaatattatccagatagctcaaatcgtttgaactaggttcttgcaaaacggcatcattgactagataatttaaattattatataaataggtattattagtagattcattatcttgattagaggcaataaaataaattaacccaaagacgacaactattataattaaaacaattagccctttatgattactgcttttatcataatcacgactttggtgctggtatttttttgcggcttgtttaacttctgccgtagtttttttggaatgattacgcaatttctctttacgcaacttgttttgttgttcttgggtctttcttttttgactttgtagtttcgcttcctgttttttttgaagaactcgtgcttcttctttttctctgattgctttttgctcattagcgatttgtttatcaaatttagacttgtactggttcattaagctgtcaaaatcagtactttgctgcggttcgattgcttggctgccatgctggtaaaaatttaagtattgatcaattaaagtgtcgatcttatcctttttatccatagcctcacccctctgtatttaattaaattgtatcatataactacatctttcgactattaatatttcttaaaattagtatcagttcaaataattatatatatgagttacaaagcataaatatacttgcaaaaatgtcgataattattgttaaaactttttaaataaagtacacttatcagtgtatttttggtaaaatgttcatagaaagagaagtgaagattatggatcaagtagaaatagtaattgtaactgggatgtcaggtgcagggaagactagcgcgatggcctgttttgaaaatctggcataccgttgtattgataattatccggttgccttattgactgaatttgcggaattagtgcaggataatcccaaataccaaagagtagcgatggcagtaagtttggatgatgcacttaaagcaattagattattatcaaatttagattggattcatctaactgtcgtatttttagattgtgatgatgaagttctagttaaaagatataaagaaacaagaaggtctcatcctttgttgatttcaaataaagcgtcttctttaattgaagcaatagagtttgaacgacgtttagcagagccgatttcacgattagcacatttagtaattgatacaacaaaattaaaaggagcaagattccaaaatttattagaagattattttagtaaagggaaaattgacccatttagaataacctttgaatcatttggatataaacatggggtacccaaagatgcagatttattatttgatgtcagattcttaccaaaccctttttacattgaagaattacgtcatttaacaggaaatgatcaagctgtttatgattatgtaattgataaagaggaaacaaaagtctttattgaaaagatgactgttttatttgattatttattaaaagaatatgaaaaagaaggtaagatgcatttaattattggaattggctgtactggaggacaacatcgttcagtttcgttaactaattattttgctgatcactacagtaaagtttatcaagttcatcggttacaccgtgatgcagatcattaaggattaagatggtatctttttcaagagttgtcaaagaagaagtagtttttaatgattttgaatcatgttgtcaaagagcaatgttatgtgcagtaattaagatcaatgggacattatcgctatcaaatcatggtctttctttaacgattagaacagagaatgctaagattgcatcaaaaatacataaaatgttaaaagaagagtatgatcctcagatcgaatttcttgtttcaagaaaaatgaaactaaagaaaaataatgtttatattttaaaggttactaaagcaagggaaattttagatgatttatcattgatggatggtttggggtttaatcagattcctaatcccaagattattgaaaaggaatgttgtacaagagcttatttagcaggggcatttttatcatgtggaagtgttaataatcctgaaacatcaaattatcatttagaaatgagttttaatgaagaagaatttgctcagtttattgctgatttaattaatcggtttgagttaaatgcaaagattattaaacgtcgtaataagtatgtagtttatttaaagtcttcagaaaagattggtgattttttacgggcaatcggagcgagccagtcagtaatgaattttgaaagtactcgaattgatcgcagcatgtcaaatactgtaaatcgctggaataattgtgatattgctaatgaaatgaaatcaatggcaacagcaaataaacaattagaagatattgagacggtagatatgtttcttggtttagacatgcttgatgaaaaaacacgtgctgttgctttaattagaaaaaaatatcctgaattaacattaaatgagctgactgaagtttattatgaagaaactggacaaacaataagtaagtccggcttgcatcatcgatttaagaaaataagtgaagaggctaaacgattgatccaaatggagagtgattaaaatggataaaattgaagttaagtttggtcatcgtattaaagaattgcgcttgaagcaaaatatttctcaagaagaattggcttttcgttgcgggttatcaaagaactatatatcagatgttgaacgtggaacaagaaatgtttcattgaaatcaattgaaaaaatagctaatggttttgcggtaaacctaaaagaattatttgattttaaatgataaacgtgtattatatctatatataaaggagttgatttgatgccactgtattatgtgattttgataattttaatcattattgttatcttaagtttgattttaaatctacttactaatccgattgtttggataattattgcgatattagttgtttggtcagcgataaaaagatatctttatactaaacagttagaagaatataacaaagaatttcaaagaaaaactgaagaaaagaaaaaggcttattatagccaagaagagtatcgtcgtggtagtgatgatataattgatgtcgattatcaagaatttgatgaagatgataaataatcatcttcattttttgtctgcaataaaacccccagctaggctgggggtctcaaaaagctttagcggagtgataatgaaaaacctcacacagtcattaagaccggaaagatatgaagaattattaaaacaaatttctaaaatagctgaagttgttggaaagaaagtataattaattaggaggaaatataacgatggaaatgacagtttcattaaaagaaaatagctatccaatctatattgaaaaaggaatcttaaaccaagctgataaatatatcaaggagatatatcaaggtaataaaatcatgataatttcggatgatcaagtttatcattattatggtgatttattaacaaacgttctaaataaagaatacattgttgagcatgtaacggttcctcatggtgaacagtctaaacgttttgatattttaccatcgttatataaagctttattagattttaaattaacaagaacagatttaatcatcgctttaggcggcggtgttattggggatttagccgggtttgttgcagcgacctttttacgaggtgttaaattggtccaaatcccaacttcattattagcacaagttgattcttcagtaggggggaaagtagcagttgatctaccagaaggaaaaaacttagtgggggctttttatcatccgagaatggttttgattgatccaaatactttaaaaacattaccagagcgttttattaatgacgggatgggagaagtaatcaaatatggctgtattaaagataaaagtttgtttgataaactaaatagttatgataactttgaacagttatacatggatatcgatgaaataatttatcgttgcattggtattaagcgtgatgtagtcgaaagagatcagtttgacttcggggatcgtttattactgaactttgggcatacacttgcacatgcaattgaacaatattatcattatgagaaatattcacatggtgaagcagttgcaataggaatggtacaattaactaaaattgccgaagaaaatgatttatcaccagtggggactagtgatataataaaagaaatttgtattaaatataatttaccagtttatagcggattaaaaacaaccgacttactggaggcaataagtcttgacaagaaaaatattaataaaaaattatcgttagtattgttaaaggaaataggggatagctatgtctatcaaagtaatctttcattaattcaagcaaaggatagggtatagaatgacagcagtaaaaattacaccgactaaattaagtggtgtggtccaagtaccaccgtcaaaatcattagctcaccgagctattatatgtgctagtttagctaaaggaatcagtcgtatcgataatattgaatattctaaagatattcaagcaacaattaaagcaatgcaatcattgggaaccaaaatagagaaatatgatgactatttaatcattgatggcacaactacttatacaaagcaaaatagtgagattgattgtgaagaatctggatcgacgctaaggtttatggttccaattgtaattgttgaggaaaataaagctcattttgttggacgcggtaatttggggaaacgaccgctaaatactttttatgaaatatttgagcgtcaaaatattggttatctttataaagaggatatccttgatctatatgtaattggtaagttaaaacccgatcattataaggttcctgggaatatttcttcacagtttatcactggactgctatttgcattacctctattagatggtgattcgattattgagatcacttcaccgttggaatcaaaaggatatattgatctaactttgcagatgttaaatcaatatggaattaaaattgtcaataatgattataaaagttttattgtaatggggaaacaagaataccaggctcatgactatcgagttgaggcagatttttctcaggcggctttttatctagttgctggagcgattgggaatgatgttgtattaacagatttgaatcttgattcgttacagggagataaagcaactttagaatttcttgaagccatgggggctaaaatttctgtagttagtgatggtatcaaggttacgggtgaaaacttagcagcaacaattgttgacgctagtcaatgccctgatgttatacctgtggtttcagtagctttagctttagctcaaggtaaaagtgatgttattaatgctaaaagattgagaattaaagaatgtgatcgaatcatagcaactcgttcacagcttaatgaattaggtggaaccgtcacagagttacctgatggaatgacgattcgcggtgttaatgagtttactggcggtaattgttctagttttgcggaccatcgaattgcaatgatgttagcaattgctgctactcgcagcagtcagcctgttgttattgataatatggaatgtgtagaaaaatcttatccaagtttttgggaagattaccagtcattaggaggaattattgatgtcatcgacgtggaaaaataatattgagataacaatttttggagaatctcatggaaaagcaattgggattgttttaggaaatctaccaagcggaatcaagattgatttagaggaagtagccaaagaaatgaaacgtcgtgctcctggacaggataaaatgtcaactgctcgaaaagaagctgacaaggtagaaataatgagtgggttacaggatgatgtaacgactggtgcaccattatgtggaataatttataatagtgatcagcattctaaagattattcattattaaaagaaaaaatgcgtcctggtcatagtgattatccagcttttattaaatatagaggatttaatgatgtacgtggcggtggccatttttcaggaagaatcactgctccggttgtttttgctggggctatagcaaaacaaattttggcaaaacaggggattcaaattggagcacatattctaagtattaaaaacgagtatgatgaaaattttgatatgcgtttatcaactaagacacttgaatatttacgcagacaacattatcctgtcattaatcaagaaaaatatgaaaagtttgttaatattgttgatgctgcacgaatggatcaagactcagtaggtggcaaggttgaatgtgcgattattggtttaaaacctggtcttggtgaaccgttttttgattcaattgagagtcatttatcaagtttgttattttcaattccagcagttaaatcagtagcttttggaaatgataagattagtgaattatttggtagtgaagctaatgactgttactattatcaagatgctctagtaaaaactactagtaataacaatggtgggattactggtggaatttctaatggaatgccagtcgtttttacagttggaatcaaaccgacaccttctatttctaaagaacaaaaaacgattgatgtaaaaaaacatgaaaatacaacattaggagttcatggacgtcatgatccttgcattgtttttagagcaactgtagttgtcgaagctatggcagcattagcaatgttggatttggtgaggtaatttatgaaagatttagaacaatgtcgtcgtgaaatcgatgaaatcgaccaacaattgattaaattatttgagcagcgaatgaatgttagtaaagatgttgtcacttacaaattagctcatggattagaaatttttcaaccagaacgtgaaaaagcagtaattgaaaaaaatgctgcacggatgctgaatccagagcttgctgattatgcacgtaattttatgcaagatgttatggatgtcgggaagagctatcaagctacttttattcctctaaataatctttataatttagctgcgccaaaacgagaaaatattaaagttggatatgcaggggtgcctggggcttttgctcatcaggcgatgttagaatactttggaaatgtagaaaatactaactatgttaattttcgtgatgtttttgaggctttaaaaaatgcggaaattgattatgggattgttcctctagaaaattcttcaactggagcaattaatgataattatgatttagttcgggattacgatttctatattgttggtgagcacagtgtctgtatttcacaacatttattagggattaagggggctaaaattgaaaatatcaaaacagtctatagtcatccccaaggaattcagcagtcagctgattttttaagaaataatcctcaaatgttgtctcaagacttttcgaatacagctgcagcagcaaagtatgtaagtgaatgtaatgatttatctaaaggagcaattgcttcaaaagtggctgcaaaactgtatgatttagaagtattacaggaaaacattcataatgaaaaaactaataatactagatttattatttttgctaaacatcttgaagatcatcctcaaactgatcgggtgagtattgtatttacattacagcataaagttggggctttatatggggtgttaaaagcaattaaagatcaccaaataaatttatcaagaattgagtcgcgtcctataaaggataaacgttggcaatattatttttatattgattttgaaggtagtcttcatgatgataatgtcaaattggcattagaacaaatgaaaacaaattgtcttaccttaagagtcttaggcaattaccatcatgcatagggagaaaagatgaaaaatattgtattaattggcattatgggatgtggtaaaactactttatctagaatgcttggtgaaaaattaaacagaccagttattgacattgacgaatatattgttgaaaaatatcatcaaacaattccagagatgtttgaagttagtgaaacatattttaggaataatgaaactgctggatgtaaagatgtttccgacttaaatgggcatattatttcaactggtggaggggttgttttaagacctgaaaatattaaatatttaaagcaaaatggaataatcatttatattgatcgacctattgataatattttaacggatgttcaagttacaagtcgtcctttgttaaaagagggcccacagaaactatatgaattagataaacaacggcatcagctttatcttgaagcttgtgatcatcgtattgttaatgatgatactttagaaaatattactgataaaattattgagttaataactaaaaataagtttgaggattaatcctcaaacttatttttttctttatttagttttttatttgtatacattttagcatctgcgcgtttgaatgtatcctttaaatcatgatcaattttaggatcataaacagcaaaaccaatagagattgataatttttcatcagtttgttttgaaagctctgtttgaattgctgttacaacagctttgatttgctgtttggcatcatgatgaataagaatgataaattcatccccgccaaaacgataaactgtatttttttggacatgtttttcaagaattttagcaacttttttaatatattcatcaccagtacgatgtccatatgtatcattgattttttttagatcattaagatcggtaataattattccggtattgtgcttatgtgttgataagttttcaaaatcgatttcaaaagcattccgattatgtaaatttgttaagtaatcagtattagccatatctttaaaacgaggatttgaaattcttctaaatgatagaacggcaatgatagtagcgataagactagccataatggcaatcaacggtgtaataattcgaatttgtttaaaggcttcaaattgatgactagcatcaaattcaattcctagcacgccaactacttttccttcgtcgtgtatagggtaatatgaaacaaaaatgggaccccaggtagtttccttaatctgatctggcaaaataattttattttttaatgctgctttaagctcaggaattatttctttttcaattttatctccaggataacgaaaatctggacttgcagttggcagtccatcgacaagatagatatattcgccttcatctgtcatttttgcagtatagagatataaaacatttgttgcattttttacatcttctaatttttgttttatttgtttataagtatcatttttcatatcaagagaaaaattatgattaaaagtatctttgtctaaataattttctacataatgatatatcgtgtttgaacgttcttttagactatagatcatatcatcgtgagtgattttataattaaaaatatagacacaaaaaaaggatgcacaaacaattatgattgtaatgatcgatacttgataatctacccgatcgagccgtttaaatttcattggtttcaacccctttctttgattctaccataaattgactaaattgtgtttagatatgctgattataaaaccaaatattgtcagtcaaagtaataatattcatcctcatcaaaatggtatttatgatataatgtgttaaggtgatagagatgcagttagaaaaacaaatatatattgataaagatttaccagctggctggaaaccatattatatttttttaatgaaagtaaacaatgaaattgtggggcgaatgactttacgagaaggtagttgtgaagaacgatactatgatggacatattggttatactgttgagcccgaatttcgtgggcattattatgcgtatcaaggagtccagttaataaaaccaatagccttaaaactagggtttaaggaactgataattacttgttcaccaaataatttagcttctaaaaaaacgattttaaaattacaagcacaatatttagaaacagtagaaatacctaaaaaatatcggaaagattttgaagccggtgaaacaattaaagaggtttatttaattaaattataaggaggaaaataatgagatttgttcatattagtgatattcatttaggaaagttgttatatcaacaaaatttattagaaattcaagctgatttactgaatcaagtttgtgattatttagtcgataacgaaatagacgttttagtcatggctggagatatttatgatcggagtgttcctagtaatgaagctattgatgttttaaatgattttttaacaaaagttattttaaagtatcacaaaaaagttttgatgatagcgggaaaccatgatagtgcgagtcgattaagttttgttagtggattgctaagacaagaaggattgtatattgaagcatatccggctaaacaaatgaagccgatagaaattgaaggggttaatttttatttaatgcctttttttaaaccatcttatattcgctatttgtatgaagatgaacaaattgttacatatcaggatgcttttcgatgttatcttgaacatcaaaaaatagattttactaaaccgaatgttttaattacccatcaatttattgctggaaatagtgaagttatgcgaagtgaaagtgaaacagtattaagtgtaggtggaacggaaattattgatgtttcattagttaaacaatttgattatgtagctttggggcatatccatgcacctcaaaaaatatcaactgaaactattcgctatagtggcagtttaatgcgttattcttttgacgaagttaatcaaactaaaagtatagttgaggtaacgattgataataaaaaagtatcctatcagcttgtatcattacaacctaaacaagacttaattaaaatcactgggagttttgatgaaatcatggcagattcgtttgccattaataataatgattttattgcagttgaattaacagattcaatgttagtgcctaatgcgattgattatttaagaacaaaattttcaaatgtattgcagattacttatccaaaactaataagtaatgaaacgagtaataatactaaagctgatcctggatttgaaaaacttgattcagttgctttatttgaacaattttatcaaaaaataaaaggtacagaactaagtgctgaagccaaacagattgttacagaaatcatgatgggagggaaagaaaatgttgcctaatcgtcttactatgtcagcatttgggccgtatcatcaagtagtgacaattgattttgagccatttattcaagatggtttatttttgattactggtcctactggagctggaaaaacaatgatttttgatgctattatgtttgctttgtatggagtatcaagtgggagtgaacgtagtagtgaacaatttcgaagtgaccaagctaatcatgatactcctacttttgttgaacttgattttattttacataatcagcattatttaattaagcggtcaccacgatatttattagaaggtaaaaaaacacctaagttacccactgcattattaacattgccgggtggtaaaatgatagaaggaatcaaagaagttaattataaaattaaagaaatcctgggaatcgatgataagcaatttaaacaaattgctatgattgcccaaggtgaatttacaaaacttatttatgcagggagtgaagagcgagaaaaagtattacgcaatttatttaagacagataattttagatgcttagaagaacagctgaaattgcgagttaaagaatataagagtaaatatgatttactttttaaacaaagagagatgttgttaaagagtcttgatgtagaagatgagaaaattgatttagatgaatatttggattcactagaaaaaaagataaagattaaagcgatggagtaccagcaaaatgcacaatattatgagcaaaaggcaaaagagctaaatgtcattgagataaataatcgtcgcttagaatatctagatgatttaaaaatccagctatcgaattatttaagcaaagaggattattatcgagaattagagaagatgatcaaagatttaaaaagagccaatcaacttcaaaatatctattcactaatgattagtagtaaaactaaattagctaagctaagagaaaaagaaaaagtcttaaatgaacgcttatcatttgcaaaaaatgatttaaaaaagcaggagaaacagtatgctttagtctctaaatatcacgatgaagttgctcagggacaaattgaattagaaaaaatggtagaactaaaacaaaatgttttagtatatcaaaaagatttaaatcagggaaataacttaaggaaacagattaaagtaattgagagtaaaaatatcggtttaactgatagattacaaaaaagtgctaaaattatcgaacgagatagtaatagtattgctcatttagataaacttaagggtgattatgagttgataaatcaaaattatcaaaaaattcatgctcataaacttgagattcataacttaagctctgattatgataaatttttaagagaagaggaacattgttatgagcttcgtgaacagtatcaaaaaattgaagaaaaatatttgaatgaaaaaaataaatatgatcaaatggaacatcattttagatcaagccaggctggtattttagcaagcagtttaaaggaaaatgaaccgtgtcctgtttgcggttctttaaaccatccacaattggcagattttgatcaaaaaatagtttatcaagaagatttaaaaaaagcaaaaaagaattttgataagtgtagcgaaacacgaaatgatatttataatgctttaatattaaaacagcaagaagttactttattaaagaaacaaatggaaaatgattgtcagcgcttaggaattgaagaagaattggggaaagaagtttttattaaagtattaggaaagatcaatatcgatgaaaataaattattaaaacaggctaaagaattggataatgaaattatttatttaaataacttaaaaataagtttagctaatcatcagaaggatctagatttattagaacagaatattcaaaaaaataatgcacaagtacaagcttataaagatcaattaaatcaagtcattggacgaatggaacaaaataaacaattaaaagatttaacgcatcatcaggttgatcagcaaattgaagaaaagcaaaaagaattgttaggtttgactaaaataattaaagatattgaagaaaaataccgttctataaatgaacagattattcaattggaagctcaaaataggtcgtattgccagcaaatcaaagatgaggaaaataattatcagcaagtactaagagaatatcgtgggaaactgaatagtttatttacagatgaaaaggaatttttagagattattaaaaacgtcagtcagcttgaaaataaagaaaaggagtatcaggcttatttaattgccaaggattctttgaataaacaaattcatgaattgcaacttgaattaaagggaattgaagttatagatgttgaagtcgtaaaagaaaaactaattattttaaaacaaaaattagattctgctttaaatattttaaataatttaaatgcccaattaatgacagtaaccagtacaatcaagaatattaaaaatattgatcaggaattaagtaatagccatgatatttatcaatgttatttagatttaagtgaggttacatctggaaaaaacagctatcgaatttcatttgaacgttatgttttagcggcatattttgaaaatattctagtttatgctaataccctgctaaaacgtatgtcgcaaggacgctatcagctttatcgtcgtgataaccgctctaaaggggcaggaaagcaaggactggaattagatgttcttgatttagaaagtggacttttacgtgatgttaaaacattgtcgggtggagagtcttttaaagcggcattatctttagctttagggctttctaaaatgattcaaggttatgctggagggatagaattaaatactttatttattgatgagggctttggttctttggatagtcaatcattagatcaagcaattgactgtttgattgatattcaacaagatggtaaattaattggaatcatttcgcatgttagtgaattgaaagagcgaattgatcataaaattattctttcacggaagaacaaagaaacaaagattgctattgaataatcactttattaatagtaaaatagggaaagattataatgaaatgaggagaaataatggcaaataataagaaaaatgatgcaataacggcgatggaagacgattttgctcagtggtatactgatgtctgtcgtaaagcagaattaatggattacagcagcgtaaaaggatttattatctatcgaccatatagttatgcgatgtgggaagcaatccaacaatacatggataaacgttttaaagaaacaggacatgagaatgtttatatgccgatgcttattccacaatcattattacaaaaagaatctgatcacgttgaaggatttgcaccagaatgcgcaatagtaacgaaaggtgggttagatgatctagaagaaaatttgatcattcgtcctacttcagaaacacttttttgtgagcattatgctaaaatagttaattcatatcgtgatttaccaaaattatataatcaatggtgttcggtagtacgttgggaaaaaacgacaagaccatttttaagaggatctgaatttttatggcaagaaggtcatactgttcatgcgagtgaaacagaagctcgggctgaaacattgcaaatgttagaaatctatgaagatactgctaaaaacttattagcaatcccaatgctaacgggacggaaaactgaacgtgaaaaatttgcaggagctgaagaaacttatacgattgaagcactaatgcatgatggtaaagctttacagtcaggcactagtcattattttggacaaggttttgctaaagcgtttgatatgaaatttttatcaaaagaaaataaattagaatatgtttatcaaacatcttggggagtttcaacaagattgttaggagcaattatcatggttcatggtgataataatggtttagttttaccgccacgggtggcaccgactcaagtaatgattattccaattcaacaacaaaaagcaggggttttagataaagcttatgaaattgaaaaacagctaaaagaagctggaataagagttaaagttgatgcaagtgataaatcaccaggatggaagttctcggaagcagagatgcgtggcgtaccattaagattagaaattggtcctaaggatatagaaaataatgcttgtgtaattgcaaaacgtaatgatggaactaaagagaagtatgcattagatcaagaactaattaatacaattgaaacccttttagacacaattcatgatgaaatgtatcaaaaagcattaaatcatcgcaattcaaatattcgtcaagttaacacatatgatgaatttaaaactacattggaaactaaaggcggttatatcaaaatgatgtggtgcggtgatgaggcttgtgaagttaaaatcaaagaagaaactggagcaaccagccgatgtattaaagaagaggaagaagcatttggtgatgtttgtcctatttgtggtaaaccagctaaaaaggttgtgtattttgcaaaagcatattaagatacgaaattttcgtatcttttttgttgttagttgacatatcaactaatgttggtataatagttgacatatcaactaatggaggtgcaaaatggaaagaattggacggattattcatcatttagcaatattaaatcgaaatgatagtaatcaaagattaaaagagtatggattaacaagtaatgaaggttctgtcctaatgtttttgagtcgtcatagtaaggtttatcaagaagaattgattaaagaattacaaattgataaaagtgctgtaacaagattgctccaaaatatggaaaataaagggttaatcaaacgaattcaatcgcctgttgataaacgtttttatttattggagatgacagccttaggtcaagaaaaacagcagatagttgaccagacatttgctaaaaaagattttattttagtatctgggttgagtgaaaaagaacaagaagaacttcgaagaatgttagatgtgatacaaacaaatctaaaaggaggtaaaataaatgaatgatgagagaatgggaaataaaaaaatccttccattattaatagaatttagtgttccagcaattattgggatgctagttaatgcaatttataatgtggttgatcgaatgtttattggaaatgcgccacaattaggagcggtagggattgctggaattacaataagttatccagttacattagtattaatggcaatttcattaatggtaggagtaggtggagctactcgtttcagcatttctttaggacaaaaagagaaagataaggcttcaatctatcagggtaatgcaattgttttaacagttgtttttgggctgatgtttactgtattagggaatatttttataacacccatgttagaagttttaggtgctagtaaaacagttttgccatatgccagcgattacttatcaattgttttgtatggagcagtatttcagtgtgttgcaatgtgtgggaataatttttctcgggcacaaggcaaccctaagaatgcaatgatttcacaattaataggggccggatttaatatcgtttttgattatattttaatcattcagttgcatatgggaatgagtggtgcagctatagcgacaattggtggacaattcttaagtatgatttggcaactgtgctatctatgttcaaatcgctctttgattaagttagatatcgaacatatgaaactaaagctgatctatgcgttagatattattaaaacgggaataccagcatttttaatgcaaatggctaatagtgttttaaactttattttgaatagtacattaggaatgtatggtggtgatatcgcaatttcaacagtaggaatcattactagtttccaaactatatgccagatgcctttaacaggtttaatgcaagggcaacaaccattgattagttataattttggggcagacaattatcatcgagttaaagaaactttaaaatatgcgattatcggtggtacaatgattgcagttgtaggttttttagcagtacaatttttcccggaaactataattagaatgtttaatggtgaggcagaagttgtaaaactaggcacaaaggcaattcgaatttggttcttatttttaccattgttaggggctcaaatcatgactgctaattatttccaatgtattggtaaaattaaagtagcaagtattttaaatttacttcgtcaagtaattattttgattccaatgattttattgttagcgactttctttggtttgaatggtattttctgggctgttccaattgctgatttaggagcgtttgtaattacaattttctgttttataaaagcaatcaaaaagctaaagtaaaaagatttctactctatagaataagacatgaaataaaaaatggattattcatagagtaatttattttttatgaaaaaataataactttatcagcattatttcctaaaatcgacattaaattctcatcagataaaaaagccatggatagaaatccatgacttacatgcctgattattttaacattttaattgaagtaattacaggctggttagaagcttcaacagttccattattatcagttactggaacagttgtagcaattttgtcaactacctcgattccttcataaacataaccaaaaacagcataatccccatctagtgaagtagttgtttgatgcataataaaaaattgtgaacttgcactatcaggatcagatgaacgcgccattgagattgcaccgcgagtatgttttaaaggattttcaacaccgttagaactaaattcacctttgattgtttcatcagaaccaccagttccattcccttttgggtcacccccttgaatcataaagccgtcaatgatccgatggaaggtcaacccatcatagaaaccttctttaactagttttacaaaattagttacagtaataggtgcttcatcagcttgaagttcaactttgattactccataatccttaacatcgatttcgattcgataattaccgcttaacaaatctttggatgctgttttcttatcttgttcatcattactttttccaccgcatccggctaagcttaatgctaatagcataaccattgtaaatttaaataatttcttcatattatctccttatatctatctgttatttattatacaaaatagtgggtgggattgtccatataaaaataatcaaaactgtcatggttaaaaaatataaaaatgtgataaaatgaatgacaatgataaggggataaaatgagatgaaaagaattgctttaataaatgatgtaacaggatatagtagatgttcgattgcagcgcagctgccgataatttcagcaatgggaattgaatgtgtttttgttccaactgcaatcctatcagtaaacacaatgcatccagaatattatttcgatgattatacggatcgaatgaatgattatattgaaacatataaaaaaatgaaggttagttttgatggaattgctacaggatttcttggttcagaaagacaaatcgatattgtcattgattttataaaaacttttaagaaaaaacatacatttgtattagtagatccggtaatgggtgatcatgggaaactttatccgacttacactactgcaatgcaagataaaatgcgtcaactaataccatatgcgacaattatgacacccaatttaactgaattatgcgcacttttagaggtaccatatccgcatgatataattaatcgggatgagctgattgaaatgtgtcgccaattgtcaaatttgggcccacaaatggtcgttgtaacagggattagtattggtgacgaaattattaactttgcatatgaacaagggaaggaacctgccattatcaaagtaaagcgaataggcgatgatcgaagcgggactggtgatgttatcagcggtgttattgcgggaagttatttaaatggtttgaatttctatcaatgtgttgaaaaagctgcaaattttgcatctaggtgtattgagtatagtcaagcagttggagctcataatcatttgggactatgctttgagcctttcttaaaagaactttaggaggaaagaaaatggtgattttatatacgctacatggtaatggatatattgatttaaaagatctagatacgtataagggaataacttgttatgttaacagcacaaatagatgtagttgtgcatgtactttttgtttacgtaatacaaaagaaatgcttgaatcaaattctctatggttaaaaagggagccgactgtagagatgattattgcggaatttgaaaaatatgatttaacagcatttaaagaagtagtattttgtggttttggtgaaccgttaactcgccacgatgatttaatgaaagttgcaaaatatattaaagagaaaaggtcagatttatcgattagaatcaatacaaatggcttatcatcaattacgttagggcgtgatattgcgcctgattttaagggagtaatcgatacagtatctataagtttaaatgctccaactaaggaagaatattatgaattaacaagagcctgttatggagttgattcatttaactacatgctccaattcacaaaagcgtgtaaaaaatatgtaccaagtgttgttttgacagttgtagatataatcggggtggaaaaaattaaattgtgtcaaaaaattgccgatggccttggagtagagttaagagttcggccgtttgaagaataataaattgtatcaagattataattatgatagaatttataacagtgaggtaattataaaatgatgcaattaagtcgtgaagaaagaatgttagatgtaaaaagtatgactaatgttcgtgatttgggtggctatgaaactcaaactggtttttatacaaaaagtcataaatttattcgttcaaccaatccaagtaagttatcagatgatgagaaagaatatctttatgattatggaattagaatgcaagtagatttacgaagtgactttgaagtcgaacagttaccaagtcaattaacgggttatcgtgatattgaatactataatgtcaatttaatgcagtctaaagatttaaatgttctccctagtgaagtaacaaattatcaagatttagctggtttttatatttttatgctagaggcaaataaacagcagtttaaagaagtttttgaattgttttatgatcatccatacgatgcaattatgtttaattgttcagctggaaaagatcgtactggggtgattgcggcattattgttagatttagcaggttgtcatgattatgatattgttaaagattattcagaatcatatgaaaataatcttaaaataatttctgaattggaacgtttggttgatgatgctaatcgcgcatttttagaatctgctccacaaatgatgatgaaatttttggactatttgagagaacattatggaagtgctaaagagtatttggtaagttgcggtcttgaagaagaaaagattattgaaattatagaaaattttgtaatttaaaaaaagtaattctcctatttgagttgtatatgataataggaggatttttttatgagaaaaacaaataaactgacatttaaacaaaaacaagaagcagtagcggagctatttaagcagtttcaccgagctaaattgaaattgtattgtttagaaaatactaatttctatccgcagttaaatatcgggatgcttcatgaaaagaaaagtggatacaatgcttcaattgctgaacgcttaaatcaacgaattgatgatagagatgaattggagcgagtggtggcagcatttgaaattgtgattcaagcattaagtcctgagagtcaattaattattacaaatgaatttgttttacagaagaatcatgagtggtggcttgaattttatagtcgagcaacttattatcgtttaaaaacaagagccttggaagaaatattattttatgtaaatatttcataattgtcatatattagcgctttttccttgaaaagactggtattttagatataataaaaaggtatttttaaaaaggagaaagacaatgcttgaaaagatttttaaattaaaagaaaagggaacaacggtcaaaacagaggttattgctggaattactacgtttttagcaatggcttatattttagctgttaacccgaacatgttaagtgagactgggctgtcttatgatggcgttttcttagcaacggcactatcttcagggatcgcaactttgatcatggggttattagccaactatccagttgctttagcaccggggatgggagttaatgcattatttacatatacccttgttttttcaatggggtatagtcctgcagcagcattggcagcggttgtagtatcaggaataattttcttgttaatttcagttactggggtgcgtaaagcaattattaatgcaattcctcaacaattaaagcttgcgattggagctggaattggattttttatcgcctttattggactaaaaaatgctggaatcattattggaagcgaatcaacatttgtggcgttagggaagttgactgatccagttgtattattagcagtatttggggtcttaataacaattatcttaatggctcgtaagacaccagcagcagtattttatggattggtgattaccgcaattgttggaattgtagctggtttatgtggtatcgagggaatgccggcaatgccttcaaaaattgtttcaattgatttagatactagtgggtttggtatatttatgaatggttttggtgagttatttagccatccggattgtattgtagcattattttcattgttatttgttgatttttttgatactgcaggaacattaatttcagttgcgaacaaaactaatttagttgatgaaaatggtgagttagataatattgaacaagcattagttgctgattctacaggaacagttattggaggaattctaggaacctctactgttacttcttttgttgaatcaacagctggggttgaagctggaggaagaacaggattaactgcttgtactacagcaatattattcttcttatcaattttatttgctccagtacttagtgttgtaactagtgcggttactgctcctgctttagtggcagttggaatttccatggcaactcaattaggtggaattgattgggatgatatcgttttcgctgcatctggtttcatcacagtgatcatgatgattttaacttattcaatttcagatgggattgcatttggttttattgtttatggtattactagtgtaattgctggtagatctaaagaaatcaaaccgattgtttgggctttaattttaatcttcgtagtatattttgctttaatatagtggaaagatacttgtgaactattttaagtaatagtttgtcaagtatcttttattatttaataaatatgatttaatttaaagttttattaataatatatgtgggttagccccttgctggctaagattatttttcaatactttctagttttgaattgattcaatcagctcggtaataaagcaatttgagtggcaagatcaatcgttgcaattaaatctgtgtttcgttagtataaaaatgtaatcaactattttgattttttactatctaagtaatcttgtttattaatttaccaaaagtagtaacatttataattactatatttcttattttattaatcatttgatattagagaataatattattttttcctaatagctattcaattatatcaagtgttcaatttgacaaagcaaggtaattgtcaatggaaacttactttaaaaaaataaacttagtttctcggcaactatttctaatataatattcaagactttaattatttacaaaaatccaaaaatttaaatataaggcaaaaagtatccaacccatgtaaggaagtaataaaaaagctgctaaaggacggatttgataaaataatttgataagaatagcaactagaatacatagtgtaatcaatattgctagtgctaataaaaaactttggtaattaaaaaaagcgataggccatgcaaaattaatcagtagttgaaaataataaataataagagcagtttctttatttttactattacttcgatgaattagataacttgctaaaccgattaaaatataaagaaatgtccaaacgattgggaatagatatccaggcggagagcacttaggaaggttaactgtttggtatacatccattgcattcattgtaaaaattgcacttaaagcaccgattcccagagagattgatagatttaatataatatatttgtattttttcaattttatcacctatattagtatagacagattatcgaaaaatattaaaaatcttaagaagtgataaagaatgataaatttttttctaatatagaaaaaaacacttctatagaaaagcgctttcatgtataataatagagtgaggtaagagaatgaaattagtatcatggaatgttaatggaattagagcctgtattacaaaagggttctatgatgttttaaaagaaagtaaagcagatattttttgtgtccaagaaacaaagatgcaagaaggtcaaattgaattagaaaagcatggatattatacttatatgaatagtgctgaaaaaaagggttatagtggaactttagtgttttctaaagaaaaaccattaaattatagttatggaattggtatcgaagaacatgaccatgaaggccgcgttgttacgcttgagtatgaaaaattttatttagtcaattgttatactcctaatagccaaaatgaattgaaacgattggactatcggatgcattgggaagatgattttcttgcatacttgaagtctttggagaagagtaaaccggttattttatgtggtgatttaaatgtagcccatcaagaaattgatttaaagaatcctaaaacgaatcgtaaaaatgcaggtttttctgatgaagagagagctaagatgacaaatttattagaaaatggttttatagatacgtatcgatatttatatcctgatcaagaaggtgtttattcttggtggtcatatcgatttaatgcccgtaagaataatgctggatggcggattgattattttattgtttcagattgtttaaaagaagggataaaagaagcgtttatttgtactgatattttgggcagtgatcattgccccgttggattagaaatagatttataagatatgttaaaggagattgtgtcaatggcaccagttacattattatcatttcttactcttttaggaataaccgtatttttctttgcatgtgtagcgtacaataaaataaaaaacaagtaatgatttatttcattacttgtttttttaaattgaaataatccccattgttgataagactgaactaattaatattattaataggccagggacaacaacatatttcatacaaaatagataagcttttttacgcttgaatttagaactgtattcaacttcgtcagtaactgttttaaaaccggttactttgatgataagtagacatgtacaagctgcagaaattggcatcatgattgagtttgtcataaaatcaaagaaatcaagaatacttaaaccaagcggtgtaatgaaatctaaaacaccaaatccaagtgaacatggaatacctaataaagcaattcctccaaaaataagaacacagcatttttttcttgaaaaatcatatcgatcttgaataattgaaacacaacattccattaatgaaattgctgaagttaatgctgcaaacagtactaataaaaagaatactaatccaataatgttaccaaatgacatactggcaaatacttttggcattgtaataaacattaaggaaggaccggcgtttagtgtatctggatttccaccagaaaaagcaaatactgcggggataatcattaaacctgctagaaaggcaattaatgtatccattatctctacttgagtaattgattgttccatatcaatttcacgtttcatatatgaaccatatgtaaataaaattcccatcccgatagacaacgaatagaacatttgtcccatagccgctactactgtcatgattgaaaaacgcgagaagtcaggaattaaatagtatttaaccccttcaatagcaccaggtgtaaataatgcatataaagcaatgaatagagccattgcaactaaagcaggcattaatactttactgcatttttcaattcctttttcaacacctagcataactacgccaaataccattccagcaaagacaagtaaccagatgacaggctgtagtgttgaagatgaaaaaccagtaaaataggtatcactaactaagctggcagaattgtttgtaataaattcaaataaatatttacaaacccatcccccaacaacacagtagtaaggtacgatgagcattggcacgatggcatttagccaaccaccaaattgaagtttttttgcacccaattgtttataggctgcaatcgggctcttttttgtttttcttcccaaggcagtttcactaattagcaaagcaaaaccaaaggtaatcgctaaaataaaatatgtgaataaaaaagtacctccaccatatttagctgctaaataagggaaacgccaaatattcccgagcccgacagcagaaccagctactgccataacatagcccaggcgaccagaaaagctacttcgcttgtgttttgtttccatttttatctcctattattaaattttcatgccttttcattataataaaatttgtctataaaagtcaattaaatggcactaaataggatgtttttgttatgattttgttaatgctgagttaaattagatcaatagtgttatgatataaatataaataagtaaagaagggataaaatatggcacgaataattgcaattattatggccttatttggtcataaagggcattcgtaatttcggtattaaaaaagatatctacgtttagatatcttttttatatattgtaataccatctttaattgtctcaatgatcttaatctgacgaatttcctcgattgcaactttgcaaggattacgatcaaggattaaaagatcagctttttttccttctttaatagaccctttcaagtgttcttcaaaatattgataagcggcattaattgttactccttttaatgcgttgtagacagatatttgttcatctgtccccaaagtaaccccgtttttggtttggcgttttacagcacaccaaatcgtttctaacatgtttggctcaataacaggggtatcttgatggaaagtataaggtaaatctaattttaaagcactatgaacacaagaaatagattcagcacgttgtccaagattacggcggtgaatatcaccccaataatagatatgagcaatgaagaaactaggaatcattccaatgctttttagccgcggtagttgatctggtcttaaggtttgactatgaatcattacagggcgtagaggtgtgtactgatcattaaaggcatcaagtagttgattggaagcagcatcaccgttacaatgagttagtagttgcgctttatcattaatagccatatctacgaattttttaacatctgaatctaagtagatcggatatccacaatagtcaccactattttcatatggcttagataaccaggcggtttttccttgtggagaaccatctagaaataacttataaccgcctagtttaaaatgatttaagtaatgatgatattgttgattatcccgatataaagaataattatttttaatatcaacataacctacaacatcgagaaataatttattttctgtcgccaaagagttcaataaatcaaattcatgctgtttcatatatccctcttgcacagttgtgattccatagctagcatagatttttaaggcatcaaggatttgtgtttttaaatttttattttccttgcttccttggcttgcaatcgtaataaaagcttgttcctcaagataaccatttaaatgaccatcctcatcacgtccgtatttaccaccgacaggatcgttaatttgatcagttagtcctagtagctgcattgttttagtattgactacacccatatgacctgatgcatgagccatcataattggattagtggtagaaattttatctaaatcacttgcagtaggatggcattgttctttgagaaaattatgatcatagccaaaacctattaacatttcttctgaagtaggattattttcttcaatataatttttaaaacattgaataatttgagcaatacttgttgctttacttaaatcaacaagtttaagtgtacttgctaaagaaacaacatgactatgactatcaataaaagagggcattaaacattttccttgtaaatcaatgaactcagtatcagcacagactagattttttatttcagaataattaccacattttttaatcacaccatcttctacataaatagcttcataatcactattttccatcgttagaatatcaccattataatatatttttttcatataaacctcctattaatattatagccattgcaaatgaaattaatattaagttaaacaaaaaatcagtttaaaactgattttataaatcttgactttctattaaaacacaattttgataataactaagattattttcattaatcaaagaaatcaaatcatcattataagtacctggctgtaaccagatatgtttgatattaagctggttacattctttaatataatctattccaaattttggactaacaacaaacacagcaacgtcaattttatttttaatggcagttagattgggaaaagttgactttccatcaatttctttataaataggtgaaaccccatacacagttttttctatttcatttaaacgttgataaatcttgtagccaaatttatcaggatttgtcgttacaccgattactgcaaaattttgataatgagttaagatatctttagcattcataatttcagctcctttattttgataaatatattatatcatgataatggcaagatatagtgatagatgcttctttacttataaaagaagctaattttataatactaaaaagattatttttagatgctatactcactaatttatattgatagacatactactatttattatatagcagtacttagcattactgaatacatggacttataagtagggaggagtagttgacttgaaggatataacagagatattaaaaggaatattagaaggctgtgttttagaaataattaatcaagaagaaacatatggatatgagattacaagacgactcaatcagttaggatttacagaggttgtggaaggaacagtttatactatattagttaggcttgaaaagagtggattagttaagattcaaaaaaagttgtctaaaatgggacctccaagaaaattttattctttaaatgaaagtggacgtgaaaaattacgactcttttggacaaaatgggaatttatgactgataaacttaatgaattaaaggagagtggtaaaaatgaataaattttttgatgattattttaatattaaaataatgataaaaagtaaaaaggaatatcgaacgcatatgaaaagggtagagcaattaccggctgattagcagtgtgttttaaaaaaattcaagcatatatgtggcagtttgtatccgggtcaggatatgatatgcttgaaattcaatggggttacttgaattatttgaagaagggcagcagtacgaagagcagttttagaaataactggagatgatgttgctgattttgtagaagagcttttaaaaaatacaagaacttatccaacggattggaaaagtgaatttaatcacgaaattcaaaaaagcttaaaataaaagcttctaaacaataaacttttataatataaagtaattgatttgataagttaattgtttttattagatactttataaagtaaaaagatgttatatctctttattgtgatataacatctttatttaataattgtttatataaggtgagatcttctttaaaagtattgattgatgcttgccagaatgacttatcttttaaattaatattaacacttgaataaacatcttctaatgacattttccctgttaaggataataatttttcataagtattgctaaattttgaaccttctttttggtaaatagtgtataatcctttagctaaaagaagaccgaaagcataaggaaaattataaaaagaacaatctgcataataatagtgtggtttccaggtccacatatatggatgaagatattgatgatctaaaccatctccataagcatctttttgagcctgaatcattagttctttgatctcttctactgacaaagcaccagtttctcttttttcaaaaaaacgactttcaaataagtatctagagtagatatcgacgattacttgggtagctcctgataattcatcttctaataagcttagtttcgtctgatcattagctttttttaaagcagctttagttacaattgtttcgcaaaaagttgaagcagtctccgcaattggcataggatagtcactatttaaaatagattcatcatttaaacattcaccatgaaagccatgacctagctcgtgagccatcgtaattgcatcagaaaagctgtcaccataatttaataaaaaacgactttccttgatactatgaagattgcaacaaaaggctccgccaactttaccgctttggggataaacatcaatccaattattttcaattgcttttttcgcaaaagtacctaaatgttcagaaaaggtactaaattgattaataataaattggcagcttttttcgtatggatgactgtcatgatcttcgataacaggggcataaagctcaaaccaaggtaatccgttttgatatccaagggcagtagctttagtttttagataatccctaaagacactaaggttttcttgcatcacagttaataaaacatctaatgtttcttttgacattcgtgcattgataagggttctttctagttcattttcataccctcttaatttagtagtatagagtacttctcctttgattccgtttaaacaagcagcaatagcctgttctttatcttgataactgtttatttctgcttggtaagcttttttacgtatttcgcgatccttatcataggccatatttaaaaccgaagttagagggtaggtttggtcctcgatagttacttcaattgatgaaattaattgatcttttagtttgctaaaagcattactaccagtattttgcatgtgtgcaatgatgctctcactctttttatctaaagtgtatttttgattttgctgaatttcttttaaaataaatagatgttccttgattaagtttgattttaatgaatcaagcttaaaagtactgatccattgttgatttaagacttcatcttcaacaaaagaagctaaaaggttatctagctgatcgctatattttaaagcaatgctatttgttgtatcgactgataaagttaaactaatataattagctactttttcaattagttgatttaattttattaaatcgactaaataattttctaatgatttttcatcattgttattacgatatgtatttatttgtttttgtaatttaatgatttggttaaaatcaatagtaaaactagaatcatcaaatgattgatataatttcgataaatcccattctttcattttctatcacctcgtataatatattttgtaaagattacagcacctttacgatcttaatttcatattggattttcctaagtaataatattctttttcaccttgctgcattctacttaatgagtctgtctttcaattttagaatgaattacctcatcgaatattgtttattcaatatattttgatgcgtagccttgattaatattgttttattcttatggcgagattatgacatatctaaagaacagaggttagtcaagtatttatttttagttatatttcaattgaaaggtgctgattttatgaatacactctatgtagatattgatgaatcaactcaaaacaatcaagtttatgcaatgaactttaatcaggacatttttaatataacttccctaacaatcctgatagatgtgataatcttatcttaactgttaagacttttgtcgataaagaaaaatttgattctataatcatcttagctaatctacttctatatacgactatcatatttgggcttatttaatagagcagctcaattgttattataccaaaatattgaaataaattaacaaactttatgctgataatgatttaattgttttcagcaagaaaaaaactgattagcagcaatgtgcataatttctcatcatgtaaatcaacattggtaagttccttgatcttttctaaacgataaagtagtgtattgcggtggatagccaattgttcaattgttttatgagagtcaccaaaattacaaatatacgattttaaagtatgataataatcattcttagttgattcatcaatttgttttagttttgtaataagtggatggagatatatcttgtatgaactagtagtaaaaaatgattctaaagcaatatcttcaaaaaaagtaaattgctgtttacttaaatcgtaagctttcagtgcttgttgtttataaatattaatatctaacagattatcgaaaatataactaataccaaactttaatttataaatatttacagcagttattaaactttttactttattaataatattgttttttgttgctctattaagcccggtaattaaaatatataagcagttatcttggagataagaatatgtatttggtaaagtaataatatgctgatgaagttgatttaaatacactatctcattgctttttaagcctacctttgtagtaataatacagtaatctctgctaaaattattgggttgtgcaggtaataatttttctaaatcatgtttatttatattgtcatttgagaataagtaattcattattgcaaaatattcgtaacgattataattatagccggttttgctgtgacaaataatagatgcgatagttttagctaatttactgataaaactgaatatttcagatgatggcttgccatctgcaaataaaatgcataagtaaccaataatattatcattgtctgttattgctgcaataattcgtggaattgtctgcccaactccgtaatcgacatagataacattattattttgatccaaatctttttgataattacctaattggataaatgggagcatctcaactgctactttttgatgttcttgcatgtgatcaaagagcatatctccaatttgttgatttggatgttgtgccaaaactacataattcacatcacataagaccattggatgatggaaatattcgtataattgtttcataaattgatgcagattatgatttattaatccattgaatagaaattcatacatatctttcataagctcacctcctttatattataaatgtagttgtgcaatttgcacaaccagtaattaaatatttgtatttttgcccatggtatttttttaacaagaaagataaaatttaaatatcgacggaggtaatttatatgaaatacgatgcattatttacaccttttaaaataggtaatatggaagtgaaaaatcgttttgttatggcaccaatgggaactaattcttcacatattgatggatgtattgctaatgatgaaattgattattttgaagcgcgagctaaaggtggggttggattgatcattatgggatgtcaatttttaaatcctgatttagcacaaggatcattagaaggagtcttacaaaatagttacgttattcctcaattgacaactgtagttgaagcgacacatcgttggggggcaaaaatttgttgtcaaattagttgtggaactggaagaaatgcttttcctaacatgtatggagaaccaccattctcttcaagtgatacaccatcaacatttaatcctgaaatgaagtgtcgtccattgagtaaagaagatattaaaaaaattatgacagagtttgctaatagcgcaataattgctaaaaacgctggttttgatgcaatagaaattcatggacatgcgggctatttggttgatcaattcatgtcgcctgtatggaataagcgaactgatgaatatggtggtagtgctgaaaatagaatgcgttttgctacagaaattgtgcaatctataaaacaggcagttgatttaccaattatatttagaattgctttagatcatctatttgcagagggtagaaccttggatgaaagtatggaattaattgagattttagaaaaagctggggtagatgctttagatattgacgcaggatgttatgaacgaattgattatattttcccaactgcatatttaggtgatgcttgtatggattatgtttgtagtgaagcgcgtaaacatgtgaatattccaatcatgaatgctggaaatcatacacctgaatcagcacttcgattaattgaatctaaagatgctgactttgttatgtttggtcgtcaatttattgcggatccagatacagtaaataaattaatgaatgatcatgaagaggatgttcgcccatgtattcgctgcaatgaagaatgtgtagggagaattgtcggacgtcttactaagttgagttgtgcagtaaatcctcaagcatgtgaagaagaacgttttgcaattaagccatgtagtcaagtaaaaaatattgttgtgattggtgcaggacctgctggattagaagctgctagagtagctgctgctgaaggacataatgtggaaatttatgaaaagactaatatgattggtggacaattaagtgttgctgcgacaccaaaatttaaggatcaattaaagaaattagttaaatggtttgaagtacaattaaaaaaattggatgtaataatacactttaattatgaagtaaaagcagatgatcaaattttaaaaaatgcagatcaaattattgtggcctgtggagcagatgaaattatacctccaataaatggtatcaataatgagaatgtaattagtgtaattgacgcacatatgcacaaaggtatgattaaaggtgaaaatgtcattatgtgtggtgggggattgtcaggtattgatagtgccattgaacttgctagtgaacatggtaaaaatgttacaataattgagatggctgatagtattgctaaagatgtattatttattaaccaggcttcaatttttgcaaagattgatgaatataaaattaatgtgattaccggtgctaaagttgttgagtttaataatgatggcattacttatcaaaaagatgaacaagaagttgtttgtaaagcggatacgattattagagcatttggaatgaaaccaaatcgtgaattagctgaagaaattagaaatacttatccaactaaaacaagaattgttggggatagtgaaaaaattggtaaggttgctaatgctatacgtgatggattctatgcgggaatgtctttataaaaataaaaaagttcgttatattagcgaacttttttaatgtatattatgtttacaaaaagctccgtaatttagtaaaatagtgtatatagatgacttatttttaagagaaggtaggagaaatatggtaaagatattactgggattgttaaaaaatatttgtgaagaaaattacgaaggatattacgactaaatggatagaaaaagaagaagacaagaatcaaaagtaaattctattatagctgaagatatcaacatgcagcaaatctaaaaaaaatatattggacaattccccaaattaaaaaaaattaagagactatttttttgattttcatgattttatgataaaatgctgcgatgatgattgtgatgttaatatacaaaatgatctaattaacaagttagaaatagaatataatttgaataaaagaatattttcaaatgctttagagtttaaagaacagcttctagaaataaaaaatgattttaataattattttaatcagatgagtaatacaacttatatatcttttgaggatatagaagatgataagttagttttatataatatccttgaagaatattttgaggttttaaaaacacatgtgacaaataaaacagagagaagatttttaaaagttgttatgttagatattaatagaaaaatagatatttctaaaaattttaaactgtttgataattcattttcaaatattagttggattgttgttttatttgtatttataattgttttgttagtaagcttaatgagtttttttaattctttattagagcaatttataatatctatggttaattatttcctaggtaaaaatacagtaataaatttgaaaaaaattatagaaaatgttattttatttgtttcttttttaatttcagttggtattatgaaactaatatttaagaaaattggaaataaaataataaatattttacctgaaatttcattgcattttcctagaagcaattatgaaagacagttgtattacacatttttatcagtattagtttctactgctgctttatttataagctatgtagcattaaccttaaaatagtgtttattttatttaaacttataattatttaaaagaaattttataggatttattatatgtatggtggtcaaggatttttagtagctcattgccaatttttctacatgcaaaataaaatataataccatcatcataatcaaaggtaatattatttttatgatctgtatcatgtttagctagattatataaattggttagatgcttaattttatagcatagtttatactctaagatgtttttgtctgaaagaaagctaatatttttacctaacattcgtgtattttttataaactttagtttagaatttttagagactaatatctttattagagattcaatatgtagtcccgaatcagttatcacaaatctagctctagagccaatatacatgtcgcttcttgcgtattgtaagcttctaaatacatttctatattcattaaattgattaaagggattaactattacgtttaaagggcaggcataaccacctagcccttttagtgattgatcatatttccatattttttcatgataaatcgtgttccttatttttgatctataaatattagctaattcatttaataagataatctcttggtaattaaagttatcctttaaaataatctctgtttcctttcgcatatgtcacctcatataatcaatatttttgaatgatatagtcaaataattcttttcttatttcattttctagtctataagtaaattgaattgctgaatttttgttatcaggtaattgtaccttgaatggttcattaattgcgtgcatttgacccatataataaaattctttagaagtagtgtcatttttattctttcttacaaataaatgaatttgaagatgattatttgcctcgtcataaattctttggatttcatcggaatcaatactacgattaggtttcgaaaaacaaataagagtacttgcatcaacaaaacgatgtaaatattttccaccttgattagcatcatgatcatgattaataaaaacaggcatagtattagttctttgatcatatttataaccgccaatatttaaaggtacggcattaacttcccagtttaataatctacatacatcctcgtaggtgtatttttgatataaacatagatcagtatctttatgtgtagtagtatagtttgttttatatctattaattccaaattcgattaattcaagtaattgttttttaaaattactatcttgtaataattcaattaattgatgatgagtgtttaaattatcatctataaagatagcatcttgaaatgttgctttagctccaccggtagcaaattcttgttttaattgattgattattggaagataattaacttctttaaatttaatcttatattcatttaataatcgttcttttaatcgtgtaataatattttcttgatattcaatacatagtttgattgctaaaagttcatgaattcgtttaccagcagcaaatttactggaaatgtattcaagatatttttcttgtaatggtgtgaatttaatcttatagtctttttcattttttgttaagaatttatggtatgaaccaaaagttttattttgaaagattcttaatacatcaatggaatcatataaatcaaaatcagctaaattaggaattctacctaatttatgttttaaatgtaaataactgtctttaatgattttagtatcattaaatttagctcgatcaattgattcatagattttctttttagaaactaaatcaaaattgattgtggaagctcctggcattaataaactgccctcactgacaaatcttcttaaggcatctttgttgtaagtataatttccacttaaagcaatagggattaagaagttcttttcataattaccaataaaatcaataattacaacatattctttggatggacttttacgtaatcctcgtcctaattgctggacaaagacaattgctgattgggtagggcgtaacataataacttgattgaccttaggaatatcgattccttcattaaagatatctactgtaaaaatataatctagactgtcaccatcattgctttctaatttatcgattgctttttgacgtttgatttcactgtcatcaccggttaaggcacaggttcgataaccacgtttattaaattctattgataattcaacagcttcagttttacgactgcaaaatattaatcctctaactcgattacctgaatgaccatataattctattttattaataatatgatttatccgttcagttgttattaagtcattaaattttgttttatcatcaatggtttttccatcaactataaaatcagatataccataataatgaaaaggacataataaattatattccattgcctgttgtaaacgaatttcataagcaatgttataatcaaacattttatatatatcaaaattatcagatctttcaggagtagctgacattcctaatagaaagctaggtataaagtaattcattaattcttgatatgactcagcaccagcacggtgaacttcatcaataatgatgtaatcaaaagtatctggcttaaacatttctcgatattcttttttatgaattgtttgaacagttgaaaagatataattactgttaatatctttatcactaccagtaaaaataccaaaagtatgattcttgattatgtttttaaaggtgttcatagcatcacgagcaatattttcgcgatgaacaacaaataatattcttttgggatcaatatttttaacatcaaaagcactgagatatgttttaccagttcctgttgccgaaatcaacaaagctttatttttatgattatttcgtaatgctgttaacgaagccagggcttcttgctgcattaaattaggatgaatatttttatgtttaataactggtataactggtttaggaacatatattttttcatattcactaatccatgattttgttaaaggaacagaatgttgccattgcatatcaaattcacctattatttgtgtaacgatgtcatcacatttattagcttgaatcttaatattccactcttggttagttgataatgctgattgggttagattagagcttccaacaatgatatcaaagttagtatcatgcttaaaaatatatccttttggatggaaatcgatttcttcatcctcgaatatgcgcacttcaatattatcaaacatcaacaattctttaaatacattaggatgattaaaacctaagtatgttgaagttattattttacctctaattcctctatcttttaaattgatcaatgactgttttagtactgctaaaccggatttgttgataaaggcaacagagaagcaaaaagaatcacaagagtttagttgattaactaattcatgtgatatttttattccttgtttatagttgttagttagcagtttagttttatttgtattattaattaaagttttagattgtaataatgtatacatgagttgctccttgtcgatattaatagtataatgcattttagtgacaataactagcgatttacctgtattaatgttaaaatatattaagaaacgggtgataattatggctgattgtatgacaaaagaacaacgttcaagaaatatgtcacatattaaaagtaaagatacttcaatagagttaaaagtaagaaagtatttatatcatcacggttttcgatatagaaaaaatgataaaacattacctgggaaaccggatattgtacttttaaaatataggactgttatttttattaacggttgtttttggcatcatcattataattgtaaatatgcaacactgcctaaaacaagacaagattattggttaaagaaaattaataaaaatgttgaaaatgatttaaagcattataaggaattagagcaaatggattataaagtcattgttgtatgggaatgtgaattaaaagagtgttttgaatatagaatggagcaattgatggaagaaatttataaaaataataatgaatacgaggagaattataatgtttgataaattggagattgggaaaaaatacacacaaattgaattagctgaaatatggaattataaatcgtatcatgcaataaggcggggaattgtaacaccgaaaggtaaaaatattattgttttatttattacagaagaaaaaatatcttatgccacacaatataaagatcacttagatggaaaaattttatatatgcaaggtgaaaataagcatgggcacgacgaccgtttattaaatagtattggaaatgacgagatacacttattttttagattaagacaccatatgccttatgaatatatgggaaaagtacatttaattgattttgaaataaaaatagatacacctagtttatttacattcaaattggaaaataagtaatttaaaactaatgattaatggcattgtcgttagaagaatcatattaaatgtttgggataggatgtcgaacaaaaatgaaaatatctcaaaataattaaacattagtactattcattcagtacctttgttttgttatgtaatttagatatgatgcatgctcccatggatgtgacatctgtggtatataatattttcttggttttgattctttgtattctacatcaaatgtttttgataacttctcatgttctggtactttttctaatataaaaaggttgtttaaatatagttatatgcttttaccataagatgactcaattaccatcgatgtagtttccttttttaataaattttgattctatttactgttacaggtagataatacttatttttataacgaatacagtgaccattgtctatcttatgtctagtttatactgctgatgattgatagactttcgtattatctggttgcttttcaaaaattgatttagttttattgagtggtagagcgaatatatcattgaattcttttatgcgggattttaaaaagttactggtttccttcatatatgaaattcttgcaagtctaagtccaatgactaaatgtgattaaagagtttgatttagttgttctacacgtctttttgcttgtaggatgcttgtagactctagttcatcacctgattgatgacaggcgtaaggggaactatgtgaacgtatcttcttcattagaggatgcgtttttctttgaaattcaaagaccattaatattatggaaagaataataaaatttaatagtagtgttttttttaaccatttgtatcaattgattttttaataataccatatttatattgctgattcattattaatttaatctttctcgtaagaatatcactttcatttgagattatgtcataaatgaaatttaggataaaatcaatttttttacactaagacatcattactttccatttatacgttaagcttaatatttgtatatttgtaaatctgcttgcaaaaaaacaataaggatgttatatttatgctatatatctgatgtggaggtgctatgaatgagctttaagaatgatataaagatgatacgtcataaatgtttgatgagtcaaatagaatttgcaaaagtattaggtgtatcatttgctaccgttagcagatgggaagctggacgtagcaggcctaatttcaaaactatgaagctaatcaacagtttctgtaaaactcagggaatcgactttgatgttagcgaacagttaatggaggaagaacaaaaatgatatataatgtaatggatctgtttgcaggagctggaggtttaagtctgggtttcaagcaaacagggcaagtgaaaatagtagccgccgcagaaaataatctaaatgccagaaaaacttataaaagaaattttaagttggcacggctttattctgatgtaagaacaatagattatgcagacctacaagaaaatgtggggtccgttgacattgtaattggtggcccgccatgccaaggcttttcgaatgcaaatcgtcagcatacaacagtaattagtatgaataacagacttgtcaaagagtatgttcgtgctatttgtcaattaaatccgaaagcttttgttatggaaaatgttactatgctccgctccagggtgcatagatttttccttgaagagcaagattttgataacgaaagaattatggcacttcctttatcggaagataaaatagaaattttgccagaatgtgttaattttgataattcaattacatttcttaaaactgcgcggactgaaatggagcttgtgtggacagaaaatttttataaaattatcaatatcctttttcgttatcgaattaaccccactaagtttgatactactcttgaaaaatatcagaaaaagctgattgtacaacttagagagatactgcatttagctactgaaaacgaagaacttaatgttttacagcaaaacgatgaaaaaatggcaaaagcaatattgcagtatattgggaagaaagataattttgatgatacaatattggctattagagattctattatgatgcagcgagcgattatgaaaatcaaagagctgactgataacaacattcatgtttttgaatacaaagaagaaaaaggtagtctcattgcaatagtaaagtcttatcctgttttggattacattagagctattttagagaatgagccttataattacacactaagtgaaaatactctcaatgcaatccattatggagctccacaaagacgagaacgttttattattgtgggactcaaaaaagaaatgagggtcgaatatatcgctccagaaattagatttacaaagggaaactatagaactgtacatgatgcaattgcggatattcaagatataattcctgccaaagaagtaacgagtgattttattgaacttgaagttcatcctgatgcaatcgggttggagaaagagttgcgaggtcgagcactgtacaaccatattactaccgcaaccagagcaacggcgatggcgagattcaaggcacttaaagctggtgaaaatttccatgaccttaatccagaactgaaaacgacatacagcaatgctgaacgtacacaaaatacaatctatatgcgtttaaagtataatgaaccatctggaacggttgttaatgtgagaaagtctatgtggattcatccagaactggatcgtgcaatttctattcgtgaagctgccagattacagacattcccggacagctttatatttgaagggacgaaagattcgcaatatcaacaggttggtaatgcagtacctccgtacctggcaagggcaattgctgaaagtattattagtatcttgaatagtgcaacagaataaaaatgggccacaccgatgatttgaggagtgacccatttgctttatgttgttgattgctcagaaatcttgcaaatctcatttgctttagcaagaattttatcatgaatacgctgctcgggcagacagtccaggatataaatgccacctagcagattgagatatttagccagttcaccgacaatatttgtgtcgattggaagtccttgtgccttggcttctatgattgcgctaaggaaaggacgaataatagaagggttgttggaagtattacgttccaaaatgtgcatgatgtagtcggaactttcacacacaaattttgtaagttcccatggatcggaacgcttttcatcatatgtaagacgaccaatccaccataatctggacagagcgtttcttgtcaaagagcgtctggctccaaaaccgaagaaaaagtgttgctgtatattgccgaccgtacattttttgttgatattccatctgtattttacataattccagaaaggtccaagacataaacctgtccataaacgctcgtcggatgcctgagaatcagacaagaaacggagattaccgtaaatacgcttgacgttttcagcttctgtaagaaagggcttctccgcggtcatatctaaagtaaaatcgggaatctctgcgaattttgtatcagaaaatagagtattgccaagttcttcttgtaaccagtcggaagaatcttgtttaaagttttcggtccagcttttaaggttggatttgataatgtcgatattatcataatttacaaattgtagcttcattgttcgtcacctcctgcggcaccaaagctacttgtcaaaaaggtgaatgcatctgtaacaggattgtttatcagcttttgagcaagatctaagcagttttggttgttaaattcttcgctttctatatcacagtcaaattgcgttgaaagagcttttgacaaaactttataccataacatatcagagttttcgattcgctcttgaataggtagagctttcagttcttccaagacatacacgagggtaggcacgacggtaagagagttaagaattggttgcgcaagtggagtagcactcaaagctttgtaactgtaaaaatcactaataggaagcttgataatgatttttcgctgggacatatcaaccagcatctgtttgcagttttcatcagggttcttacttatattgaagatggaaggggtgtttgcaagatcatcaatatctttagaaatatctacagtgaccattttgcctacagccattacacagccagcttcaatctcaaaatctatgccttgataatcttcgtgaaaatctggactggtgtaagatttcaaatcatcgactgctactatgaacggacagatttgtaatttcccgttaacagccttgctcagtaatgtgtatacttcgctgattttttcagtttgaacaactgtacgaaaaccagtctgtgcacattctaaatgatagatatattttgcaacaccttgtttgatacaatcctgaagactttggcaagtgagagttgcgagaaaatcaatacgtagatcgtaaccatcacgaacaatatcaatagttacatcaaaatcgccagttccataatcgtttgaataagatgatagaacaggataaggatataatttatacttgatttccatatgccttcacctctaaagaacaataatcgtgataatcaagctgaatattaagcttaagcgcttttttcgctgtaaatgtcatatttgtaattttatttttatagatcttcaaatcagggcattcagagcaagatgccgcaacaatagtggcagcatagttctgcgattcagcagacataaatacttctaaagtgccatttgttgcagaggaagtaggggtaaacacaatcgtgtattctcctgttgccttgttgcgaaccacattacgaacactggctgcagaaatagcagatagcttcttatgatattcaacaggaacattgcctccaccatcgccaggattactgcctccaccatttctaccatgaccaccctgtccttggttgctgttaccaccttcaccaggaatggcggtgacaataatatcaccttcatcatcgtcaacgagggttttattgagttctccagtttgtgtaccaaaaggtttaggtgcaacttcagtaacacggactttaatatcttttatactattctgcagggcttcagtacgttcttgattaggggatttgtcagagtcggttgcggatagatattcaccaacggttggatcgagaacttcttcactttcgtcgtttttcatttcatccaaagatgttttgataaagcgagtcaatgtagtaagaagacgtttagcttttctcttattctcagcacgctctatttcccattcaagatgctgtggattttcaagactacggagataggagttgatggtatcaccttcaataaataaggtaccagcgaatggaatcaaaccattgatgtttcccttatctttgattttcattcctgtttggcggatcatcgcaacacgtctactgaaagatggcataatcatcaatttcaaggtaagcttgccaatagtttcgttatcatctgtaagctctttggtgaatactcttgccaatttatcatctattagcgtctgatagtattcatcagcgtgttcattaaagtattctttgtgagaaatcattaagtctgccaatgtgtctttgctgataatggtttcatcgacatctactaccagggtaccgttgtaaatagcataaagaaaaccatctaaaatagaagctaccatctggtgttgccatctactatcgccagtaaaagcagcaatataaatatcggtaccggaattttcgacactacgggagtatgtaggatctaaggaatactgtttatacatagggctgttcttgtcgttaccatagaatcctattccctgagtaatttcattctttttattcttgaatgaagttaatctggaaactccctgagatgcacatataccatttttgtcgcttgtgctgtagaaaacggttcttagggcggagcaggcatacggcgcaaatttaccaataccaaaagatccaccatgtcccccggatttatcggatgcaccagaagattttgttaagttacaccaaggagagttgtattcttcatgagatccaacaagaccggaagtgttaaaatcactaattcttaaacaagtgactgtgggcttatgtattgcatccagcgcctggttaaaaaatatttttgctttggcagattgttgctgtgaccaaaaatcaagagatcgtttaagggcatcttccaaagtattataatcaggaatgttatggggatcaatttcaaatgttttaaattcaatgcgtgttggctcttcgttttccatacttgcatccaaagagttttggcagatttctcttgctaaagatttaatgggcgtacctttgaaagtttctacaccagaatcagcaattccgaaaatttgtccgaagttatttgatggaaaattccatttttgtgttagattgaacatatttattacctcctacttttgcttaaggtaaatctgggagttttctcaggttccacctttgtgaattttttttttgcctctcgaagctcctgttcaatagcttggaaaatttcctccacttcatccatcgtatattcgtatacagatgtatttgaacaattactgaggagctgtaatgtatcgattattttattggttcgggcttcagcaagtctgacaaacttatcatgtttactttctttagcttgttttttcataagaaactctccttcctgtttaataatatcatatcaccaaaattcgacatgatcaataatattttaaaaatgttatataatatttttaaaatatgataaatgatataaatatacagatcatatataaagggcaataaaataaaaatattaatttaaatattgcatatattttgaaataaaacaaaggaaagagaacaattctgtctatccatagatgaatgtatggatttgttttaattacaggcggttgggcttatcttgtcggaattattgttgatgcattatttattgctgttgcagctcttatggttgttgattttaatgattgtgaagacaaagaagaaacaatttcaattgataatatcagtattgtaattgaataaacaagattataagagctattatgaaaagaaaagtatatgtgatcgaagtcgctgaaaaagagattctttttaaagcattagttttaaatttaaagaatggcgtagctttttgactatgtcatcctgtaaatatcatatcacttactagtaggtatgcgcctaataaactaccgttttttatgtttgaaaatatttagggcatattgatttttatagttttgtttattctgatatgataaaatttttgtagatgcgaggatcttaacatggatgaagaaaaattattaactgaaattcaaattttaaaagaagaaaataaaaaattacgacaattattaactaagtatggatatgtttttgaagagactaaatttagttctgaagataaaatgaaaatatatcgtaattattttagaggtcgtgatgatatttatgcaatcttttaaaaacagtcagttttttcagcgtgttataatcgaacgaaaggaaattgttattacgaaaaaggccatgaagtttgttcaaaatgtaatagctccaattttgttccactaactgatgatgcaatcagaaatcatatttgtaaacctaaccaaagaattggcctatatccattattaaaagataatacatgttatcttttagctatagattttgatgaggatgactggttttatgctatgttgagtgcgtatcgagttgctaaaagatatgatattgatagtttaatggaacgttctaaatcaggtgctggtgggcatttatggatattttttgataataatatttatgcttcttatgcacgaaaattaggatttttcttattagatgaagcaatgaaagtgaataaacgaatttcatttaaatcttttgatcgtttatttcctaatcaagatactatgccaattggtggctttggtaatttaatagcattgccaatgcaatacgatgctataaatagtaataaaaacactctatttattgatgaagacggtaaattagtgagaaatcagtttatacatcttgctaatattaaaaagactagttcattaaaagtagaagaaatttgtcagaaaaataccgaagggatttttagtaataagataagtgaagaaacagctgtaaagtttaataacgaaataaaagtagttgaagattcgatgctaaagatttatcgtttaaatttaaatgctcttacacttaatacaatcaaaaagatagcatcaatttggaatccggaatattttttatttcaaaatacacatcgtccaatatttcataaaacgactccagctattttatcagagtatgaagaatcagataaatatctatatctacctagaggattaaaggataaactattaaagatttttggtgaaagattacaaatagaagaaattacagaatcaggtcacgaaatagaagttcagtttaagggagagttagttgaataccaagaaaaaattattgaagaattagataaacatgatttgggtatcgttaaagccccaaccggttcaggtaaaactataatggctttagcgttgattactaaatataagattagtacattaataattttacctggtaaagaattgttaaaacaatggaaaagacaaatagataattttattaaatatcctcaggcaaaactaaaaagagatcattatattggggaatatactggaaataaaaagaaattaaaagggaatattgatattgcaacaattcaatcgttagtaaatgttgaagattttgttattttacaaagatatggattagtaattattgatgaatgtcatcactgtgccagcaatacttatcgaacagtattaaagcgactgaatgctaaaagaatatacgggtttacagctacacttgaacgtcaagatggactggaagaaataacatgtatgtacctaggaaatattgtcgctaaggtgagtgaaaaggatattactaaatatcgggattatgaacaagttttgattcccagttttacaacttttactatgctagaagaaaagtctaactttattgaagtagttaatattcttataaaaaacgaaaaaaggaatcatttaattattacagatgtagttagtgaatttaaagaaaagagaaatatcattatattatctgatcgggttgagcatctagagtatttatatgatcaactacgacatgttgatgaacatatttacctgtatttaggtaaaactgataaaaaagataaagaaaatattcttgaagaactcagatacgctaataattttaattacataattctagcatcatcaaagctcattggtgagggttttgatttaccaagtttggaaactatgtttatggcaacaccattttcgtggaaaggaagaacaaaacaatatttaggtagattacatcgccaatatgaaggaaaagaactagtaagggtatatgattatgttgatcataaggttggatttttagtaagaatgtttaataatcgtttaaaaacttatttgagtgaaggatataatattttagagagtagtgaactttcaccattaaatcagtatttgtacgacaattatattaaggctttagaattagatatgttaaatgctaaagaagaaattattattcatagttctaaaatattactatcattaatcaagaaatcttatcaatttattcaatccttattatatgatggaattagtgtaattgttgtgataaaatcacaagcattaaagcaaaatgatgaaatagcatatttaaagggacttggagtaaaacttatttatagtgaagcacagattaataacattattatcgataacaagattttgtggataccaaatcgtggatattatgaaagacaaaataatgtaaatgcattccgtattgaagatgttaatgttattgaagagattatatcaataataaaagataatacttgagatgagtaataataaatatggtatactataagaggtatataatatacttattatttggaggtatttagatgaaaagagttccaatcggtatagaaaattttaaaaaaatgattgatgataattgttattacgttgataaaactggattaatcaatgatgttttaaatgaagaagtaattctgtatacacgtctaagaaggtttggtaaaacattaaatatgagtatgctgtattatttcttttcaattaaacaaaaagataatgcttatctatttagagatttaaaaatagaaagaaatattgaagctaaaaaacatcaaaataagtatccaattatttttattatcttaaaagatatgaaacgtaataattttaatgatcaaacagaaaagtttgcagctttaatttctgatattgtcgataataatatagaattgttagagagccttgtttaaatgaatgacaaaaaaacttattacaacaatatttaaatacaactagctcattatcaaatctacaagatgctctacttaatatctcaatttgtttacaaaagcattatcatgaaaaagtagttatactaattgatgaatatgatgtgcctttacaagaagcatatataaataactattatgatgaaatggttgattttttaaaaaatgtttttagtgctgtcttaaagacaaatgctgttttacaaaaaggtgttttgacaggatgtttaagaatagctaaagagagtatttttacgggtttaaataatttttctgtatgttctgttcttgatgagatatcagataatcgttttggctttacaaatgaagaaataacagatattttaagttattatcatctagagcagtatcaaaaagagtttaaaagatggtatgatggatatttatttggtaaaacagaaatatataatccctggagtacattattatatgttaacaaattaattaaaaccactagtataacaggtgaatcattttgggctaatactagtggtaatgagattatttatcgttatataactaataataatcttaaactaaaagatgaatttgatattttaattaatggcgggataataaaaaaagtaatcaagccggaattaacatatcgtcaaatggatgacctcaataatatttatagttttcttctttttactggttatcttaagattaataaatacttagattacaattattatgaattaatgattcctaattatgaagttaaaatgatctatcaagaaacatttgatgattggactaaagaaattattgaagataatagtcaaaaactaatagatgcgcttttaaacaaagatgaggataaagctaataaaattttaaattatattttattacaatcaatcagttatcatgataataaagaaagcttttatcatggttttataatgggtttaatgaatggtaataatatttattctaatattgaaactggtgatggacgcagtgatataaaatacttaccagtaaataaagaaaaaagaggttttatcttagaactaaagatagttaaagataaagacctctatgatactgcggttgaaggctgtaatcagattattgaaaaacgctatttggaaggtgaaaaagttcgtggatatcaagatatagtaggttatggagtagcatttgataagaaaagatgttttgttaaaatggtcaaacaataattactccatattctctaataaattattaataaaactatcataattataactatgaataatactttgttgtaacttagcattattaacaatttcaataaagatatcataaaggtgctcaatgtcttgttggtcacctcgttttattgctagtaaaaagataatctgaaccgtatcttgttgataccaggttaatggtttatcgatgatagcaacagcaactttagtatctttagcacataggcgcataggatgtggtaatgcaaatacttcattcatattagtttttgctaaattttcacgttccataacacaatcaaaataattgctatcaacaatattttgtttttccattaattgacacatttgttttaataaagattctttagagtctattccatctaaatgaataaagaggtttttatcaaaaaatttatttgatttcttcattttatttaaagaaattgatgttagaaatttagagattgcttcgatatcttgattatttaaagcaaagtcaacagtaatggtaggaatatgtttactctttaatggtattgtagaaataacaaagtcaatattcaataattctctttttgtataattaataaattcgttatatgaagctttacgaacaattgttatcttatctttaaagaaaacatttaatctagcttctaacattcttgttgtagcttgaccagaaccacagactaaaataacacttttgttttgaaggcttcctgaaaaacaacgctcaatcgcagctccgatatgcaaagaaacataaccaacttcatcttcagttaaaatatatggtggcttattaaagatttttgcggtacacgttaaagtaatatcaaatgctaaaggaaaattagttttaatggtatttaataatgggtttcgtttatttaacgcaaatgatttagtatttaagatagatttaaaatgtaaaaagaggtcatgtgacaaaatttcatcattacgcaaatcaaaattataatcaaaatatatattattcaataattcttctactaactccttgattttattatcattatcgactaagtcgtttaattgtgtattggctactaaatgtgaataaatatattttttttcaccttcactaatcgtaatattaaaagtatactcaatttcatttgcaatatcatcaataaaatcagtataattatcatcaattttaatagtattgttcgtattgatataacagtcaaattgaattcttgagatcattaaagcaaaatggatgattaggtttttaaaattaaaatcatttgtttttatatgtgcattttttaatttattagagataatttgtttaagaagatctagatcaattccctcaaaaagagtatattcatcttttgtaaagccggtaacatagttttgaaagttgtacgataaaacattttcaactagacatttgcgtttatcatcttcattaccaattattttgaccccgacattagtttttgagatatattcaagattatattttgaaaaaatagcttttaaagttttaatatagttttgtaacgtatttttactcacatagatattatcagccaaatcatctagactcatatattcatcactatataataataaatttaataaatatttaatccgatcttgagaactgtctaattctaaattactagttcttgtttgttttattgaacataaaaaagtattatatttttcttgatcattgatctcaatataatatccagcttttctttttaattttatttttgctccatttttttcaagaatttcattaattgcctgaatatcactacggatcgttctatctgtgatgtttaatagaactgataactgacttgcagatactatattatcttgtctgacatagtcaaatatttcatttaaacgattgtatggaaacatcattatcacgattccttccttattatgtctatattgtatagataattgtttttgattgcaaataattgatttccattttattttggaaatcttgatgtttataaagtaaaagtttccgttaataagtggaaatagcattgattgaaataaatttagattcgagatagactatagttgtagcaaggaggtagtaacggaatgcttaatgaagattatatatttttagatgtgaaagtgacgaataaaaatcaattattagggtttattgcagacaaagcccatgaatataatatttgtgacaatcgagaaggactgcttgaagatttaataaaacgtgaagcagaatttccaacaggattgcaagatggattcgcaattccacatgcacgtagtaaccatgtcaaaaaggctgcaattttatatttaagaactgatgaagcaattgagtggggaactatggatgataaaaaagtgaattatttattctcattgttagttcctgaacaaaatgaaggaaatcttcatttacagatgatatctaaattagctacttgtttattagaagatgagtttaagaatacagtaaagtcggcaactaataaattagagctaaaagattatatattaaaaaatatggaggtagattaaatgaaaatcgttggtattgccgcttgtcctgcgggattagcacacacacctatggcagctaaagccttagaaaaagcaggagctaaattaggttatgatttaaaaatggagcagcaaggaagtatgggtcaggtcaacaagattactgaggaagaggctaaagaagcagcttttgtaattgtagcatcagatcaaaaaattctaggaatggagcgttttgaaggaaaaccggtaattagaattgatattacaacttgtatcaaagctccggaggcggtcataaaaaaatgtgttcaagcaacacaaaaataaaaaagcaatttaacttggcggagtcaaattgcatacacaaaactatagtgagtagtgtgtactctcattataacataaaatatgaaaagagaggtaaaacgaatgaaaaagtttttaaaagatgctaaaggacatataatgtcaggaattggttatatgctacctttaattattggggcatcactagttgtggctattccaaaattgataggggtagcgatgggaatcaatagtcttgatgcttatgcaacaaaagatgggttcttacacatcttatatttattagagcaggtaggttggacaggtattggcttagttaatactgtattagctggtttcattgccttttcaattgctgacaaacctgctattggagctggtttaattggtggggcattagctagtaatacaaaagccggttttttaggagctgttattgctgcgtttatcgctggatatattgtaaaatggggtaaagaacatatcaaattacctgattcaatgcagcaaatgatgccgttagttattttaccatttttagcaactggtgccgttgctataattatgggagttattcttgcgactccactagcctcaattaatgatgctttagtatcgtggttaagagatatgtgtagtggtggaactagccaattgatcctttcattagttttaggagcaatgattgcttcagatatgggtggaccaatcaataagtcagcatggatggctggaaatgttttaatgacagaaggaatttatcaaccaaatgtatatattaattgtgctatttgtattcccccattagcatatgcaattgctactgtaattaagaaaaatcgtttttcaccaagttttaaagaagccggtaaaggtaactgggttatgggatttattggtattaccgaaggagcgattccttttacattagttaaggctagccgtttaattcctattaatatgattggtggagctttaggagcaggaatctgttgtttacttggagcaactgctgatattccgccagttggaggaatgtatggatttgtttcaatcactggtggttgggcttatcttgttggaattattgttggagctttatttattgcaattgtagcaccaatggttgttgattttaatgatgataaagatgaagaagagacaatatcagttgatgatattgaaatagtaattgaataaaaaataggaagatgaaaatcttcctattaaattaaaggagttaatatgaaaagaaaagtacatgtgatccctcattcacattgggatcgagaatggtattttacaacttcaagatcaaaagtttatttaatgaaagatcttaaagacgttttagatacattagagacaaataatgattttaaatattttatggtcgatgctcaaggttcattattagaagattacattaaatggatgccacaagataaacaaagaattaaaaaacttgtcaaagctaaaaaattaatcattggaccttggtatactcaaagtgatcaactagtaatttctggtgaaagtatcgttcgaaatatgtattatggaatgaagtgttgtgaaactttcggagagtatatgaatgtgggttatgttcctgattcatttggacagtcaggtaatatgcctcaaatatatcgccagtttggaattgaagatactttattttggcgaggcgttagtgatgatatggtcaaacataccgattataattggcgtggtgatgatggcagtgttgtttttactacccaaattccttttggttattatattggtggaaatatacccgaagatgataaagcaagtgatgagttttggcaaaaagaatgttttgaaaaagccggcagccgtagtgctacaaaacatatttacttccctaatggttttgatcaggctcctattcgtaaaaatcttcctgatttgattaaggaaagaaatgaaaaagatcctgataatgaatacattattagttgtgttgaagactatattaaagatgtaaagagtgaaaaacctgatttagaagaagtgagtggtgaattagtaattgccaagcatatgcggattcataaatcgattttttcatcgcgaagtgatttgaaagtgttaaatacgcaagtacaaaattatgttactaatattttagaaccgatgttaacaatgtcgtatcatttaggtaatgattatccccatagtgcagttagtgagatttggaaattgttatttgaaaatgcagctcatgattcaattggatcatgtatttctgataacgctaatgaagatgtgtatatgcgctataaacaagctcgggatattgcggttaatttagttgagttacattcacgtttgattgcaactaaaatcaagaataaaactaataatgagatcaccttaacattatttaatacattaccaaaaaaacgtaatgatacaattgtttttgaaacatatttaccagctgataattttacaattaaggataatcatggtaatcatgttaaatatactgtaattgaaaaaacagatcttactgactatgttttatcacaaacaattcgattaaatcctagtaaaaatatttatttgccaagtgtagtctatcaagcaaagattgccatcgaagctagagatgtaccagcattaggttatgtgcaatatacaattaatttggatgataaatctaatgacgatcttcaagaaataacaagcatggaaaatgagtattatcaaattacagttaataaacaaggaagtcttgatatctatgataaactagctgattatcattatcaaaatcaagctgttcttgttgaaaatggtgatgatggtgacagcttcaattactcgccgccacgtcaggatttagaaatattttctattaacagtgaatttgattaccagataattggctctagtctttatcaaaagacaacgatcaattataaaatggatattcctgctgatttacaagaacgggctaaacaacatacaagtattaagttaccagtaactttagaagtagttttaagaaaagattcaaatgtaattgatctaaacgtacatgtcgataatcaaggattatcacatcgtttatgcatcttatttgatagtgcgctgacgactaaattcaattatgctgatcagcagtttggtttgatcaaacgaccaaacacttatgataaagaaatggagttatatcttgaaggattaggaaaccaggagaaggtagaaaaaccaaaagaattagctaattgggtcaatgatcaatctacttggcaagaaccaccaatatcaattgaaccaactcaaagctatgttgctcttgccaataaaaatagaggaattgcggttattccccaaggggttcgcgaatatgaaatcattggtgagcaaggaaatcaaattagattaacattgtttagaacatatggctttatgggtaaagaaaatttagtttatcgccctggtcgagcttcaggtgaaagaatcattgcaaccccggttgcccagttattaaaagaaatggattttaaattagggtttacaacttttaattgtaatattaacgattcaaatattgatcttctcgcaaaagcatataatactccaatcgaagtatatgaatatgctgatttcttaaatggtagattgatttttgcccaagaagatgaggaacaaattttaccagttactaattcattatttgaaagtgaaaataacttagttgttagtgcaatcaaaaagagtgaagatggtgaaggatatataattcgtctatttaatggtaaagatcatcaggatattggtgataaactaacttttaattttgatataagtgaagcatattatactaatttaaaggaagagaagattgagcaaatagatattgttgataatagtgtagtaattaaaccaatatcacattgtaaatttattacaatattaataaaataatgaaattaaacctatatagaaagtacaatgattgtaattctaataggtttttattatatctcttataaattaacaaaatttttaatagcttatattaggtgttatttattttatattaattcattatgtatatagacaaaaagattaaaaaactattgttaaatatttgtatttaaatattaaaggaaattatttataataggatttttatgaggtggtttgacattaattatatagggtgtacaataggtttagaaggtacttttaaatattatgttatttatgataataggagcataaaccatgaaaaaaattacgtatatttttatagaattatttttaatgttattaataaaggcggcaaggcagcttcaagctatatacataagaaatgttaaaagattattaggtacaattatgactatatggaaagatgaagtgcaatattggagagtagtattttcagtatcgattttgtacaatatattcaatgatgtttaaatcaaacaaattaatacatattctggtaatttttcttgtcgtgtcagttacgggttgtcaaaataatccagaagaaatatcagcttctggtaaatatatatcttatacagtaactgcagagaatgatgataaatctctagaaatgataacatttgcttatgatttagatgatgactctaatattggagtatcaaaaatggaatataatgctcaatatcctttaacagcttatgataaaaagaacaataaggtttattattcttctagaatagatgatgctgataatctttttgaattggatttaaaaacaggtggtactaaacaattgacagattctttatttgcaataaactatattattcctgtagataatgaattatatttagttgcagttgaaaatggtgtgcgagcaatgggattgtttaagcttgtaaataataaattggaacgaattcttgatgatgtagatgcatttgtttggaaagtaaattataatcctgatttacagacattggtatttaatacatactcacagtctgaattagataaaaagatggaagagccagatgatggaacaccaaggcaaggtaaaaatactatttggacattaaatacggcaaataatgagtttaataaagtagcaacaacaaaaccaggatatataactgatatatctatggatgaggaagggaatatttattactgtatgggatatttttatcaagttaaagataatggtgaatcacaaaaaaatagtgaatttaatgatttagggatattatcagtaatttacaataataataaatatttgtattatatatctaatgaaggtactttaaataagtatagtaaaaatgaaaaacaatctacagtaatatataagacatctgtaaaaaaaagtgctttaaataatgctgttattttatctagctttaccaatactaatgaataataattatatatttttaaaagtagaaatactgatttattcaaatatttctactttttgcttttataagaaagtataattgttactatacaaagagaaaattttaaatagttatttttatctgtattttattaaaatgttgtataactttaaaatttgtatttagaatgaattgaaaattaatagaatatctagatataatattaactaataatgaattaattttattaatatgatatattaattatatagtgttaaaaacaaatgttttatgaataatgattatatgaggagataaggatgaagaaaataacagtgagaatagaggattttaaagaactaattgataaagattatttatatattgataaaagttatcttatcaatgatcttttagatgaaaaggttgttttatatacaaggcctcgaagatacagcatgataatgcttatctctttaataatttattaataaataaagttataaaagctaaagatcatcaaaataaatatccagtcattcttattactttaaaagatatgaagcgtagtaattatagtgagcaggtagagaaattcgcgtcaataatctcgaatattgttgatgataatattgaacttttaaacagtttatatttaaatgaatgtcaaaagattttgcttaaacaatatttgaatgctaatagttcatcttctaatttacaagatgcgcgaaattatgccaatatgctattaaatcgggtccagtgtgttgatgatgttcaagaactgtgtaattataaaacagcaattaccaaaacttgtatggtttataacaattacactgtaagagctattcgtcctagtgtttataaaaggccgtttattggtttggaggcattgaaaatccaaaaagaacagttagaaataaaactcgattcatgtaaagaaataatggaccagacccgtaaattatataatgatactaaaaataaactacaaattattaagccaagtgaagcgggaatactgttatcacaaagtttaatcgttgatcagtttattcagttagaacaggaattacaagaaactaaggctaaattaaaagaaattaaattagatgattcttttgttaccttggttggacaactggatgaatgtaaagtaaagcaaaaaaataaacaaaatgagttaactttaaaacaacgacagtctcttgaatgtgaaattaaaatcaaagaggataatcaggcttatcagcaggtgattagtgctttagaaatagttaaaatagatgaatcactgatcaatgacaatattactaaaatcatgaatcactattataaacgttatggtcgtaattattcgacgattatgaatgtaatcaataatcgcatcaaagatctagatattgaattaaataaagatataactaatgtttgttatgcaatgaaagcatacaatcatcaatttaaagtcggttatggcaaagatattgcagatatcaaagtttatcaagagcagtattataatctccgggatattgaaataagtaaacgaattgaagatgttcgtaatgctcgacgcaagtgcgaacaatcatttcaggaatcatttatttccaggttgtatgaaaaaatcgttcaagctcgtaaagacattgatgaattaaatcgcggcttaaagaataaaaactttaatggtgatatctacgaatttattgtgggacctagtaaacgaaaagaatatcgaaaatattatgatatcattactactaatcaaaaatatacaagtgatgatttatttattacgactttatcagaagagaatcgggcagttatgaatgaattatttaaccagattgctttgttaggagaagatgaaacgggtgaaagtattttacagcggtatacagattatcaggagtatctagattatgatattaagattacacatgataatggagatattacgtatttttctaaagttaatcgtgaaaaatccggaggagaaacacaaacaccattctatgttgtaattgcttcaagttttgaacagctaatgaaaaatcgtccgaatgaggattcaggctgtattgttttatttgatgaagcgtttaataatatggatgaaacacggattcaagaaatgatgaaattttataatgaattaaatgttcagatcattgttgctgttcctccggctcgttcaagtacaatcatgccatatgttgatacaacattaatggttattaaagctggtaataactcatttgttgaggggataattcatgaataatcagaaatatattcttgaaaaactggtaactaaatatgagcgtagtgttttatatcgtaagggatcaacattaaatttaaaaataaaaataaaaattaggcaattatatcctaattatgatgccagtgatttttattgcaaacgaaaagaaattgatgaaataattgaacaattatttcatgacaacctaattgaagcaaagtatgatgatgaaggaattgtcgagataacattaatattaaccgataaatcattggaacaaacatatcatttaattaaacgaccatttaatcgtgataacgaaaaaaagacgttggaatatttagaaaaaatagattttgaagtcatctggattaataagtttattaatgaaatggttaaaaaacttgtggatcatcaaagtgttaatcattatttaccaattgatgatccaactgatttagaagatattattgttattttacagtgtcttaataaacagtttcaagaaatttctttacgaaaattatcgttaaagttgtttaatgattcaaaacgctttgaaagtttaaaagggagaattgttaatattataaatgattattatgaagaacagtttgatgatgaagaagaaatgctggcgcattttaatattatcaaaaatcctggttttatctatatatcagggaatataatcattgaaataaatgggcaggttattgatttaggtttgttagaaggaccgttttcattaatgagtaagaatattgaaatgatgaagatcattgaaataaaagatgatcatgttttaacggttgaaaatttaacatctttttatgatttaaatttaaataatactttgataatttatttaggcggctatcataatgcattgcgacgaaaacttttaatagatatctataagatgaaaccaaaattaaatttttatcattttggtgatattgatgcaggtggattttatatctatcttcatttaattgaaaaaacaggaatatcttttaaaccattagcgatgaataaagatatattaattaaatatgctgactattgtaaaaaactaacagttaatgaccgtaagaaattatctaatcttaaagaatatattactgatggtacaattgaatatatgttggaacataatgttaagttagagcaggaaatagtagatatagaggatataaagataatatgagcaatgattaaaaataatacataatactaggtggataatctattaaaaggaaattctttattagtgcattttttagtataaaataaaagaactaaacatttgtatagttcttttatttttacatcctatgttgatattaatttttagaatttctatatttattaaaataaatataatttaaatacatcctatgttatttattaacaacaatatcattatatatttaaaatcaaataaaatcaattagatattttaataatttttatattatcatatatatatttatataattataaagatatataaatatgtggttgatttattattaaacatactgtatactgatatttgtaagttatttatagattttcttattaaaatttaaagaaaggggaattgtgtatgagagaggataagactaatcaaaaaaattatatatttaaaatcaaataaaatcaattaaatttaatagtatattttatataatcatatatatatttaaataaatataaactaatgaagatatatagttgatttattatcaaacgtattgtatactagtattcgtaggttgtttatagatttttccattaatacttaaatatttaaagaaaggggaattgtgtatgagtaaggataaggttgatcaaaaaaatggggtaaatgtaaatataagtaatgtaaatattaatgttatcggtaaccccaaaaaagagcatttttttgatagtatattaaatataataagaaatattttactaaaaaataataacgtttaatttttgtggttattaatgtaagtgtttttgcttgatgatggaatatattttataatgttgatagtaatttctgatattataagtataattgaaaaatcactagtttttaggattatggttgtatgcatgaattgattaaatattagagttgcatatttgaacttcacagttgtttatatggacttacagttataattaatacacttcaaaattttttgttattaataatattgatgtgttagaaaagataaaagagcgaattgcctaagcagagtaccagataatgacaaacgcaaatgttaaacgtaatatattgttttgggatatagaatggttgattcttggatatagtcagtggggaaatggatggtttagtacagtactttccatcagatagaaagtaatctgtattataagctagtattggcagataaaacaacaaactttaagaaacaattagctaatccttttagtgaacagacagaagaaactattaaagattcttatatttttgattttgtactgaatgctaaaaaaatcggtgggatatgggatagaagatgtatttatctaataaatcataaacaaatttgttgtagaaataaaatggtagaatttgaaccagggtttgcaggaaaatatcttttttcctgtcagtagttgattaaaaattaaatttgccaaatgataatcctgttatgattaagtggctgacaagatgatcaaagaatacatagaagcaaaattaagctttaaagtatgttattttgaagaaaatttgtttaataaaatatttatgttggcgcgactttaggcgctgagaaaaggagtaaacatggatgtatatgaaataaagataaaattatatttattgaaagatataaaaattgaagaaacacagacttatttagcatactttattgatagtgtgatggttaaagataatatgtttttaggtatacatgagactaatcagtataagttttatacctttgacagtttgtatcctttggctaaaaatggggtttatcaaaaagataatgcgtatgtgtttagaataagaacgttagattatcaattagctcaatatttatatgatactttagctaaaaatcggactaaagaatttcaaggtctgacagctgaagttaaaataattaaacctaaattaattaaaaagctgtatacacttacaccagtaattttgaaaacggagcagggatattggaaaaatagtattaaaacagaagattttgaagaacgtttaaaaactaatttgatcaagaaatacaaagagattactagtgaagatattaatgaagattttcaattatattatcaaatcaattttaaaaataaagttccagtatcaagaaaatataaaggaattaaattgttaggggatatgattgaattagaaattgcggaaaatgataatgctcaaaaattagcaatgttagctattggagcaggtttattggagatgaatgcgcggggattcggttttgttaattacatatattattgaaaggaggttatataatgcttgatgaatgtttacgaatttttaagcaagagcttaaagataatacaaatttagttttaaatacaataattttggctgacggggattatgttttagtacatagcgacggtacttatgatgttgaaaaaattaaatattcaaaaaaggatcattgtttaatcgaaaagccagaagatgaaatatatgataaattatgtttttatgattatcaaagtcagttagtgagtatgaataaaccacaagatccagggaaaacgattcattcaaataactatttatcattgtttgtaaaaaaggaaagttttaataatggtaaaatgaatgatgaagcaattgaaagatacttcaaggccttagaaaatccccaagacaaatataaaggtaaagatttacagatgtataattttgcaaatgataatattagtgagattgatcaagaaagattgttacataataagcaatggttaaaagagcatatatataatttagagggcgttgattataatgagaaggattatttaaaaatcttttttgaagtagatgaccaattatatattgatgaaggaaatcgttatcttttaaccaagatatttaattgcaatgattataatgtttatgataacggtacggtttatggattacccaattataatctgcagttaaatgctaagaagccttttttagaaaataaaaccaggatgcataaaattccatatatggtttccttagaagatgccttattacaaaaacagttttttgattatttgttaaatcgagtaagtactggtaagagcaatgtatacataaatgaagacgatgataaaagaatctattgtttagataatactgaaaatatagataagggatttaatggattttatcttaaaactaaaaaaggtaaagaattagaaatacactatatggatgttgttactgattataaacaatatctaaatcctttatttgattttgaaaatgttattggtgctttagacgacgaatgttatcgagaatataaatatcgtaatgacgttgaaaaattaattaataatattttgttttctaagtatttaattaataattattttaccgctccggatgatataaaaggtattaaaacagatagtgtttacaagagtaatcttttaacctgtaggaatgcaatttttgcttggacacgtgctggaagagttgataatattggatatatattaccaaaagcagcattaggggttgtaattaattcaattagaaaagaatatataagattagctcaaaagcagttaaatctttattttgctttagataaatattttaataaacaggagaataatatggaaaatgtaagagagagcttgcgaactaaaataaatagcgagcatcaaaatgtaattgaaaatgatttagagtatagctttgcggttggtcaagcactagcttatctgcaatcaaaaagtaaggctaaaaataaaactcaggatattattaatcaatttattgttattagaaatgatcgggttttaaaaataaaattaaaacagttttatcagcggtataattacagtttatttgtagggaaaacacggtttaattatatgttttcgatgattatggaatatcttgatgtaaataaaattgatcaaggaatgttattagctggatatttaggagaaaatttaatttatgaaaagggagaaaaggaaaatggataaaagagtatacggagtaattggaatatcttcaataatgtcgaattggaacgctgatttttctggctatccaaaaagcttatctgatggaacgatttttggtagtgataaggctttaaaatacccaatgaaaaagatgtgggataatgaaggtcaaaaagttttatatatgaaatcaatgaaattttcaccacaaaaagatggcactgtaacattagtacctaattcattaaaagaaagatatgaaaaattatttgatgttgatgatttaggaaaatgtaaagatgctaaagaagtattgtctaatttaatgagtgcggttgatgttaaaaactttggagcaacatttgcagaagctaaaaataatatctcaattactggtgctgttcagtttgggcagggaattaataaatatagtgaaagtgtagctgaagaacaacaaatcttatcaccatttagagatagttcaaaagataaagaaaaagatgaagaagcaaaaaattcaactttaggtactaagatcgttagtaatgaagcgcattatttctatcctttttcaattaatcctagtgcttataaagaatttgtggctttaggagtcacagatggctacactgaagaagattatttaaattttaaaagaacggctttagtagcagcaacttctttttcatcaaatgctaaagagggatgtcaaaatgaatttgctttatttgtggaaactaaattggatacatatttaccaaatttaagtgagtatattagttttgaaaaaacagatgttaacaagattacaattgaatgtaacatgttaaatgaattagaagatgttttaaatattgaaatatattataatcctgaaacaacagttttagaatctaatttacaaaaagcaaaaacttataacctgattactaaaaaagaggtgtaacatatgcaggcacttaaatttactttaagtggtaaaacagctttttttaagcgtccggaggtcaatacatattattattttacttttggtaatattcataaagttgcgctattaggaatatttggggcaattttaggttatcagggctataataatacgattgaactaccagagttttatcaaaaattaaaagatatcaaattatctattttgcctcataataaaaaaggttatttttcaaaaaaaatgcagtattataacaactcggttggttatgcttccaaagaacagggtggtaatttaattataaaagaacaatggttagaagctccttgttgggatattgttgttttgttggataatgaggagtcaaataaattagctaaagctataataaacaaaaaatgtatttttataccatatttaggtaaaaatgatcatccagctaatatcactgatcctgtaattgttgatttagagaaacgtaatatcgatgaagaatctttggtctgtttatttcctaagggagattttgaagaagctgaagatattgatattgatttttataaatatcaagaaagtttaccaattggattaaatgaaaaaacgggattgtatgagtatatgacatttattcatactaacctttatatggatgaaggtagtgtatatagttttgaagaaaaaaacattgtattttattaacccgctattaagcgggttttattaaagggaggatattatggatatagatagatatctagtttcgctagaaaaaataataattaatattgatcagtgctatggacatagagatgatgatcatcaagaaacaattaatgaacatattcaattatgcacaaaatatttgaaagaaatatttaaattaaagaaattggatttgattttaaaatcttttaacatttctttaggagaggggttatcagatgaaggaaaagaaatgtttaatgagttattttttaacacaattacttttcatgataccggaaaaataaatccagtttttcaaaatgataaaatgaataatccagtaatgaattatttaaatccacctaaaaatttagaatctgatcattcaaaattatcggcatatatctatttaggatattatttaaataaactagaaacactaacaaaaggtgatattaaattattaaaatctattatctatataaatgcttttgtaatttctcgacatcatagtaaaattgatgattttagaacacgctttattgataagtttgatagtgatgatgaattagaaaagagaattattgattgggttaatgatgatgaattcgcaaaattgtttaaagatggttttagttttatacctttaaaacaaaaaggacgtgataatttatttaaaaaactaagaaaatatgaaactaataagcaaattgatttatatgtctatgttagattcttatattcacttctggttttttgtgattattatgcaacaagtgaattttatggtgataatagaaataatgtaatgcttaaagatgctgattttagtgaaatcatggaactatatgataatagtgaattagttacaaagattagaaagaatgatgttggaaaagaaaaaatcaatgaattaagaacgaagatatttttagacgcagaaagaaatatactcaaaaatttagataaaaatatattttatctagaggcaccaaccgggagtggtaaaagtaacacagcactaaatttaagtttacgtttaattgaaaatgatgatagtttaaataagatagtatatgtatatccttttaatacattagtagaacaaaatctagcatcgctaaataaaatttttggtaatagtaaggctatgaataatattgctgtcgttaattctacaactccattaaaaaaaggtgaagatgaaaacttttcggatgaatatcaaaaagcattattagaccgtcaatttctaacatatccaattattctaacgacccacgtaggtctgtttgatactttttttggaaataaccgagaatcagcgttcggtctatgccaatatgcaaattcggtaatagttttagatgaaatccaaaattatcgaattgaaatatggaatgagataatcattttcttaaaagagtttgctaaaattcttaatctaaaaataattatcatgtcagcaacattaccagatttagaattacttacagatgatcgtagtaattcagtttcattaataacaaatcctcaagaatattttttaaatccaatttttaaagatcgggtaaaaacagactatagtctaataaatgtagaaaatactgaagaagcgttattaaatcatgttttgaagatgaataagttaaagaaaaaaataatgattgagtttattgttagaaaaagtgcagaaatgttctatcgtcaattaaaagatatagaattagattgtgaagttctatttattagtggttttgatagtgtattagaaagagaaaaaatcattaatactgttaaaacttcaaaacatcttattttagtagcaacccaggtaattgaagccggtgtcgatattgatatggatatcggttataaagatatatctaaacttgatagtgaagaacagtttatgggaagaataaatcgctcatgtaaagaagatggaaaaggaatagtatatttctttaatttaaataaggcaaccaatatttataagggggatgaacgtgttgcacagaaaaatttaacattgtttaatgatgatatgaaagaagtattgttaaaaaagaactttaattattattaccaaaaacttcttaagactctagcaaatagagctaaaaagcctggggaaaagaatgttcctgatttttttatagaaagtgttgcctgtttagattatcaggcagtaagtaaacgaatggaattgatattagatactagagacagggtaacgatatttttaggaagaacggtaattaatattgatggggaagaatttgatggtaaagctatttggaatcagtatgtagatttattgaaaaataatgaaatggattatgctaaaaaagtatatgagttgtcagtggttaaaagtatgatgaattattttatgtatcaagttattaaaaaaaatcaatttgatttcaaagaacaggttggagatatttattatattgaaaatggtgatgattatattttagatggtaaattgaatactgctctttttgaaactgaggatgagttatttatatagaggtaagaatatggaagtaaatggaacattaataaactattattttcattgtcaaagacaatgttatcttcatggtaatcgacttaatttagaggatgaaagtgaaaatgtgaagattggtaaagcattgcatgaagaaaagtataaagatgataagaattcagagattgcaattggcaatattagattggataaattaactgcaaaatatttaacagaaacaaaaaagtctgatgctgatttagttgcagcaaagtggcagcttttatattatcttaaaattttaaagtcaaaaggaataatacgaaaaggacgaatagaagtaattgaaaagaataaacaaaataaatcttttattgaagtggagctaacagaaattgaagaaaaagaattagataaaattgttattaaaattaaagaactattagaaaatgatcaaataccaccagttttaaatgaaagtaaatgtaaaaaatgtgcatattatgcatattgttatatataggaggtgttgtaatgaaaagtactaaatacataactagtatgggagatttaaaacgtaaagatgattcactttgttttagaaaaagtggtaagaatatatatttaccagtagaaaatataaaagagatatattgtttaaatgaaatttctcttaatactaaattattagattttatctcatctaaaaatataattattcatttttttaactattatcagggttatagtggtaccttttatccaaaggataaatatactagtggtaaattgttgattaaacaggttgaaacatttaataattatcgtattgatattgcaaaggcaatagttaatggcattgcaattaacgttgatgaaactttatatcactattataagcatggtaaaaatgaggttaaagaaacaatagactggttaagaaaagaggtgccaaaacgtttaaaaaaagcagaagatattaaaatgattatggcggttgaaggagaaatatggcaacgtttttatagtatgtttagatatatattacctgaagattttataatgaacaaaagagtaaagagaccgcctgataatccaattaatgcactgatttcttttggaaacactttactttatacaaaaacaatttcagcgatatatcaaactcacttaaatcaaagtatttcttttttacatgaacctacagaacaaagattctctttatctttagacttaagtgaagtatttaaacctatcattgtttttaaaacaatctttgaattagtcaatactaaaagattaacggttgagaaacattttgataagaaaactaattattgtcttttaaatgataaaggcagggatatatttattgaagcttttgaaaatagaatggaaactaaatttttacataccaaattaaagagaaagataacatataaaacagctattaaatatgatggttataaattaattaaaacaatttttgaaaataaattatttataccattttctataaaggataaatattaatgaaaataaaaaatcataactatgtaatcgtctgttacgatattggggaaaaaagagtaaataaaatatttaagatatgtaaaaaatatcttcctcattatcaatattctatttttaagggtcctattaccccttctaaattaattttattaaaaaaagaactaaaaaaagctataaacaaagaagaagattgtgtaagtattattaaattacagagtgaggattcatttgatgaagaaattttagggagtcaaaaagagggaaatgaagatagtttaattatataatttaccaggctcaatttctttttaatgtcctaaaactgttgggagagtaagcgtttaagagaattttactagcaattataaaaaagtaaaatcatttggtaaaaaagtagaaaagtattgatagatatagggtttgaggtataatagaaagtgtaaaatggcttatttactagggtttaataacaacataagatgtattgaaatccaaagaaaaattgacaaaaatctaattcgttttgtttaataacaacataagatgtattgaaatatcgtaatatcttttgttatatcaacatttgaataagtttaataacaacataagatgtattgaaatttcttcgccatattgtacttttggcaggcatttgccgtttaataacaacataagatgtattgaaatctccatatagaaccacaaacatttgtaacatcatgtttaataacaacataagatgtattgaaataacagtgctttcaaatcatgcattacttcacctttggtttaataacaacataagatgtattgaaatagcagtgaatccagttcaccggcagacgtatgtagtttaataacaacataagatgtattgaaatggtacttttattaatgcgtttggtgaaaacgaaaaagtttaataacaacataagatgtattgaaatatatcgtttttaacatacagtttccagtcaatgacgtttaataacaacataagatgtattgaaatagaagcgttagataggctttgtgaaaatgattattgtttaataacaacataagatgtattgaaatctgttgattctggatcgtatgtattaaattcaacaaagtttaataacaacataagatgtattgaaattacataatgcaaaaaaaatgaaaataaatgatagagtttaataacaacataagatgtattgaaataaaactaaacattttaatttagctttagcaatataagtttaataacaacataagatgtattgaaatccattttgagaaaaaccgtaaataatcgcataagtggtttaataacaacataagatgtattgaaatacacaatcttgagtatttattgctttttttattatagtttaataacaacataagatgtattgaaataaaacgttcaaatgacaacggtgggttattaaacgggtttaataacaacataagatgtattgaaatgtattgaaattacgattaaatttaccgtcgatactggtttaataacaacataagatgtattgaaattaatttagtaggcaagagtttttttgttatacaccgtttaataacaacataagatgtattgaaattatgcaacacctacattcttgttaagccaggtacagtttaataacaacataagatgtattgaaatagatcagatagcggattatcacctttatcaaaaagtgtttaataacaacataagatgtattgaaatgaatttaaaatatgataatcttctcttgctactggtttaataacaacataagatgtattgaaatcttaatacattaagcgagcattgggtcgaagtcatcgtttaataacaacataagatgtattgaaatctaaaataaagtgattaataaaacccaaaatataggcgtttaataacaacataagatgtattgaaatctaaaataaagtgattaataaaacccaaaatataggcgtttaataacaacataagatgtattgaaatcaaccattagcagaaatagttatctcttgttcaacgtttaataacaacataagatgtattgaaattagcttcattgaccgcttcttgcttaagttcttcgtttaataacaacataagatgtattgaaataacacacagctttataagatggctggtaatagcattgtttaataacaacataagatgtattgaaatgactcttcacacagctgcctgtgctcctttaaaaggtttaataacaacataagatgtattgaaattccagcatgctcaatgcctttcccgtacgtttccgtttaataacaacataagatgtattgaaatacatacatatcacttacagtttcaccggccatcaggtttaataacaacataagatgtattgaaatgattgtgcaggatcgaaaccataatcttttacccgtttaataacaacataagatgtattgaaatggtgatgaatgtaaaattgctaaaattgtaactctgtttaataacaacataagatgtattgaaataacatttctttagcgcttaattcttctatcattttagtttaataacaacgagatattaaagtgaaaaaacatgactattttgttcatattactattaataaaatatttttttgttataataaaagtaaaagtaagtagaagtggggtaattatgacaaataagtatagattaaaaataatatataaagatactaaattgacattagatattgaggaaaatattacttttgatgaattaagctcaattattaatgaaaaattaatgctaagtgattcgagagcttataaatatcaaaaagatgatgatattattgttacaagaaaaaatagtaaaaacaataaactagcagatcttttagaattagatcagaagttagtttatattattggtactggtaataatgtttatagtattaatatcatcgtttgggactacattattgaagctgataaaaaaatattagagaagtttaatcaaatgttgaaaaatgtcaaacaagtacgtcctgaacaagtatattatttaaatagtagtcaaagaaagtttattgacggtcttttggctgactgttatgaaatgttgaaagaaatgagttttagtggaatttataattaccgcttatttaaaaatggtgctgattttttaacaacgaaagtcatctattatattcttgatgataaatatgaaattcatttatataacaataatgatgatttaaaggaagataatacagaatatttaataactttttatgatactaatcgagcttattttaaaggataccagggagttaatcgtaatattttcattcttcacaaagataaaacaattaaacaaaatgattttgaatatctttatcacgctttaaatcgtatcattcatatgttcaaggatggtgatgaagatacattatttgaaagccatgaaacatgtttatgttatgacattgcaactaataaattttggactgaataataaaaaagcatcgtcttattatactaacgataagacgatgtttttattcagaatgatcttcaaaatttaaattttcatcaaagaactctttaccaacaactttctttttatcacgggcatcttctactaacttagaaattaaatctttaacttctcgagcattttttatattctttaaatgaatttcacgttcactgtcagctttagtgtacaaaattactgttccagtaccaaagattttttgtgataaatttcttcgtagacataaatcggtaatacgatacaaaagcaattcgtcatagtgagtactaaataggccagtctcttgatataggcgatcattttttatttcatatttagtaaaactaattggaaaccacataaaatgtttacgatcttgccaaataattttattttccatcataagttcctccaattacaacattttatctatgatgattataacagtaaagagtagtcaattctatgattattgaaataatctcattataaataaaaaaataaaacaaattatgcaaataagtttgtatatatcgcgtaattatgctatactcaccaaagtgtctagaaaggtataaagaatgattgaaaacaaatttaatgaattaggattaagtaatgaagtattaaaagcaattgaagatatggggttttctaaaccgtcaaaaattcaagaagaagcaattcctgtattattgacaggagttgatgtaattggtcaagcacaaactggtaccggtaaaactttagcatttgggagcgttttgttgtcaaaaataactccatctcaaagaaagttaccacaagctatcattttgtcaccaacaagggaactagcaatgcaaatccatgaagaaatggaacgtattggtaaatataatggaagtcgaattacttgcgtatacggtggtagtgatatagagcgacaaattcggaccattaaaaaaggaatcgatattatcgtagggacaccagggcgagtaatggatttaatgcgtcgtaatgttttgaaactaaacgacgtaaaattcgtagtattagacgaagcggatgaaatgttgaatatgggctttgttgaagatatcgaaactattttagaaaaagttgatgatgatcgtcaaacaattttattttcagcaacaatgccagcaggaattaaaaagattgctcaaaattatatgcatgataattttgaacatgtagctgtattatcaaaacaaacaacagctacatctgttaaacaattctattacgaagtgaaacaaaaagatcgttttgaagcaatgtgccgtttaattgacgtcgctaatgttcaaacaggaattattttttgtagaacaaaacgtagtgttgatgaagtaactgaacaaatgcagcaggcaaattataatgttgaagcgatgcatggagatttatcacaaaatcatcgtatgaatacattgagaaaatttaaaaaaggaacaattaattttttaattgcaactgatgtagctgctcgtggtattgatgttgaaaacgtaacacatgtaattaattatgaattaccacaagatattgaatcatatgttcatcgaattggtcgtactggtcgagctgataaagaaggacaagcttattcaattattacaccaagagaaaaaggatttttacgtcaaattgagcgtgtaacaaaatcttctattaccaaagcgactattccaactctgcaagaaatttctgaagcaaaaattggaactctggtaagtaaagttgaagatcaaattttggctggtaaccataagaagttcaagcaattggtaaatgaaattgatccaacaatgttagcagactttacggcagcattaatgtatatgacattccaagaacagttaggatatgattataaacgtgatacgattcaggaggcttctgaaggtaaaaggcgtgaacgtggccgtggaaataataaagattatacaagaatttttattactgctggtagtatggatcgtgtcaaagcaccacaaattgttaatttctttgtttctaaagcaggtgtgagaaaagaagatatcggagatattgatatcaaacgaaaatttacatttgttgatattaataagaaggcaatcaataaagttgttgataagtgtaataagcaaaagattaataatcgaaagattgaaatcgaaattgcaaataaaaaataaatatttggtgaaaagattgtgttttaaaaatacaatctttttttgtataaaaatatggtattttaaaagcgcttacacttgaatgaaaaggctaacacgtgtataatatatttatgtattaattctaaggaggattagattgaatgaaaaaatacgtttatatgtttagcgaaggaaacgaaatgatgcgtgaccttctaggtggtaaaggggctaacttggctgcaatggttaacttagggttaccagtaccacaaggatttacagtgactactgaagcatgtaatgaatattatgctgatggtaagatcatcaatgatgaaatgaaaaaacaaattgatgactgcttagaaagattagaaaaattagctgataaaaaacttgggggattagataatccgttattagtttcagttcgttctggagcaaaattttctatgcctggaatgatggatacaattcttaacttaggtttaaatgatgaaactgttgaagttgtagctaaacaaacaggaaatcgtcgttttgcttttgatagttatcgtagatttattcaaatgtactctgatgtagtttgtgaagttgataaagagttatttgaagctaaattaagtgaattaaaaacttcaaagggatatgaaagtgatttagatatcactgcagaagattttgaaaatatcattattcctcaatataaagaaattttcaaaactcaattaggtagagactttccacaagaagctaaagaacaattaatgggagcaattttagctgtattcagatcatggaataatgatcgtgctattatttatcgtaacttaaatggaattcctcatgatttgggaactgctgttaacgtacaacaaatggtatttggtaatatgggtgatgactcaggtactggggtattatttactcgtaatgctgctaatggggataatcatatttatggtgagtatttaattaacgctcaaggtgaagacgttgttgctggtattcgtacaccacaaaaaattgctaaattagaagaagatatgccagaaatctataaacaattagttacaattgttaaaggattagaaaaacattataaagatatgcaagactgtgaatttacagttgagaatggtaaactatatattttacaaactcgaaatggtaaacgtactggtaaagcagcattaaaaattgctgtagatttagtacatgaaggtttaatcaataaatatgaagcaatgacaagagttgaacctgatcaaatctcacaactattacatccgaactttacacctgctgcattagctgctgctgaagtgttgattgaaggattacctgcttcaccaggtgctggtgctggtaaagtttatttaactgctgaaaaagttcatgaacaagctgtagctggtgaaaaagttattttagtaagacacgaaacttctcctgaagatattcaaggtatggttgattgtgaaggtattttaacttctactggaggaatgacgagtcatgcagctgtagttgctcgtggtatgggtaaatgctgtatcgtaggtgcaaaagcattatcgattgattatgatgcaggaacatttacaattgatggaaaaacttatccagaaggaacagaaatttcattagatggtacaagtggtaaagtatatatgggaattttagattctgaagaatctgaattaacaggtgattttgctgaattgatgtcttgggctgatgaaatcaagaaattacaagttcgtgctaatgctgatagccctcgtgatgcggctgtagctattaaatttggagctgaaggtattggtttatgtcgtacagaacatatgttctttgaaggagatcgtatcgaatatgtaagacaaatgattttatctgatacagtggaagaaagaattaaggcattagatgagttatataaattccaagttgaagacttcagaggaatctatcgtgcgatggttggattaccggtaacagtacgtttattagatccacctcttcatgaatttttaccacatactgatgaagaatatcaagcagttgctgataaacttggaaaaacattagaagaagtgaaaactaagggcgcaactttaaaagaaactaatccaatgttaggacatcgtggttcacgtttagcagtaacgtatccagaaatctataatatgcaagttagagcaattattgatgcagcgattgatgttgaaagagaattaggatgtacaatcgtaccagaaatcatgttaccattgattggtagtgaatctgaaatcgtttatgtgaaagataatgttacaaaagcaattgatgccgcaattatggctaaaaatgcaaaaattgaatataagatcggtacaatgattgaaattccaagagctgctttaacagctgatgaaattgcaaaacatgctgaatttttctcatttggaactaacgatttaactcaaatgacatttggtttctctcgtgatgatgtaggaagtttcttgcctgaatatattaatcgtaaagtaattcaagttgatccattcgtatcgcttgatcaaagtggtgttggtcaattagtagaaatggctgcaaacaaaggtcgcagtgttcgtccaaaaattaaattaggtatttgtggtgaacatggtggagatccagaatcaattaaattctgtcataaaacaggtttaacttatgtatcttgttctccatatcgtgtgttaattgcacgtttagctgctgctcaagctgctgctgaggaaattatcctagaacacactactgataaagtattagttgctgataaatagctgataaacgtctcttaatttaaagagacgtttttttatttgtgtaaagtaggatatttggtataatagatatggtgataaaatgaaaaatattataattgtagcaacaggtggaacaattgcaggaagtggcaaagttggaaaagcaactaattatcaggctggaaaaatcaatattaaggaaataattgactctattccaatgattaatgaagttgctaatttaaaagcaattcagctttttaatgtcgatagtaatgagatgaatgaagaacattggataattttagctaataaaataaatgatttggcttctcaaaaaaatgttgatggtattgtagttactcatggaactgatacattggatgagacagcctattttttaaatcttacaatcaatacatataagccagtcgttttgacaggggcaatgagaccagcgagtgcaactagtgcagatggtccgattaatttatatcaagctgtttgtttggcttcgtgtgatgatgctttgggacatggcgtaatggcagtcttttcaagtacaatttattcagggcgagatatccaaaaaattagtaattttaaaactgatgcatttgatcaaaaagattttggatgtttgggttatatgaatgatgataaagttatgatgttttcaagaacttttaaaaaacatacattgcaatcagtttttagtgaaaagccaattactgaattgcctccggtagggattgtctattactatgctggtgctaaacctgatattttgacgatgatggctcagaatcatcgagggattgtgataattggcagcggtagtggtaattatagtcaagcatggctgaatgaaattgaaacactagctgctaaaggaatcatttttgttagagcgtctcgggttaatcagggaattgtatatgagagtgatgtttttgatcctcataatgtctgtataccgtctaatactttgtcaggacaaaaagctagagtgcttctaatgcttgctttaagtgttactcagaatacaaaagaaattaaaagaatttttaatgaatattaaagggggcacatgtacgtggaacgaatcaaacttaatttagatagtattgcaatgatgctgttttgtgctcgattaaaagcgtataaagaggtcccgctttctaatgaggaatggttgttaattgagcggattataaaaaagaaggggttaaaaggacctgctagtttgctgtcgatgaatcagacagaacttgaagaaattttagaaataaatgaatttattgcttataaaatggcacgaagaattgaaacgatgaatatttttttaagtgttcttaataatctggaggggaatggaattaatgttactacaaaatatgaagataatttccctaaattgttaactaaacacctaaagaaaagggctccattatatgtgttttattgtggtaatattgaattagttggagaaggaatttctttgatgggtcttaataaggttactaaaaaagatcgcgcctataccaaaagattggtagataaagcaattgaagataatctaatttacatttccaatgatgctaaaggaattgatgatgttgctttgcattacgcactttatcatggttgtcattgtattagttttgtttgtgagcgacttggtgctaaaagcaaagactatactagatatattaaatccggacaattagtgatgctgagtgctgaggatccaaactgctattttgatgtaactaatgcaattgagcgtaatagctatgtatgtgcattgtcaaaatatcaaattattgtttcaagtagtattaataatggcgcaacatggtttacttcgttgcaaaatttacacaataaatggactacacctttagctgttgaagggttatatttaggaaatgatcggttacttgatatgggagtgacaccaatatatataaaagatgtattgtctgattattcgttcgatatgatttatgatagaaacaaaaaaattgttgaagatgcagaagtcaatattgatcagatgtcaatatttgaatttataggagaatagaatgaattttgattataaaaaatatccagtgacagccggggtgattggaatatgtattttagtttattgttatacaaccgttaaatacggttttgaaatgaatgcttatcaaggaatcagagcaggtggatttaatccaatttttgttttggcaggaaatcaatattggcgattaattagtgcaaactttattcattttggaattatgcatattttttgtaactgttattcattagttaatctaggctcagttatggaatatttgttgggaatgaagcgttatttgattattttgattgcttctgcccttgcaactacgattttaccaacagttttttatattttgactggaaatggtgctagtagtattatgggaggtatttctggagctatttttggattgatgggagctttattagcattggcttggaaatttaaagatgtttatgcatatttattcaagcaaatatcgtcaagtgttctattgatgctgctgatttctatattggtgccttcgatttctttatctggacatatttcaggtatgattggtggttttattgcaactttactaattatcaaatttatgcctttacgcatttggaaaaagaaaaaaccggaaaattatcataatcttgtcaattaataatcagatatagtaaaatataaacatatagaggagagtacaatgaaacaaaaagtaagaaaagcaattattccagcggctggattaggaacaagatttttaccagcaactaaagcactagcaaaggagatgttgccaattgttgataccccaacaattcaatatattatccaagaagcagtggatagtggaattgaagaaattttgattattactaattcaaataaacatgcgatggaaaatcattttgataagtcgtatgaattagaagcgcgtttaacagaatcaggtaaaatggaacaagttaaaatgatacaagatattgctgatatggcaaatatttattatattcgtcaaaaagagccaaagggattaggtcatgcggtattatgtgcaaaatcatttattggtgatgagccatttgcagtattattaggtgatgatattgttgtaaatgatggtggtgagccagcattaaagcaattaatagatgcgtatataaataaagaagcatcagttgttggggtacagacagttgaacataaagatgtttgtaaatatggaattgtcagtccgtcacattcgcatcctcgtgaaaatggtgggcgtttagttaagttaaataatatggtggaaaagccggcagttgaagaagctcctagcgatatggcagtattaggaagatatgttttgacaccaaaagtatttgaattgctagaaactcaaggtaaaggtgctggtggagaaatccagttaacagatgctatcaaacgtttaatggatattcaagcggtctatgcgtatgactttgaagggattcgttatgatgttggtgataagtttggttttattaaggcaacgattgattttgcattaaagcgcgaagatttaaaagaaaaggttcaagcatatataaattcacttgtaaaggatgttaaatgatgagttttcaagagaaatatgaagagtataaacaaagaaaagaagcgcaagcgttttttaatcaaaataatgatcaaaaagtatatgggaaagattatttgatagctattttagttggatttggttcaacgatcgttatgggatgtattttaacctggattatttctaaaataggttttaatttttcatactttactattttaattggaatttttgaagctcaggcaataaaaaaagtattgaataaaagtggtcaacaattagccattattgctgcagttacttttgttttaggaattgtcgtggcacaagcaatttttataagtataacgctacctttttttaatgtcagcatgctagttgaaacattcaaatattgtttccaaaatatgataacaggtgatgtgttaagtacaattatctatttatttggtgcgattgcggcatatatggcattaaaagattaaatatattaatttaaaagaatataattggctgatcggttttagtgatcagcttttttgttatattatttttaataaagattgatggattcaaggtaaatggattgttaaataaaaacattctttttatttaaaatgaaaaaataatgcctttctatatttgtgagggtcttttagtaattataactagcaatacaaaaggctacgtagtataataatggtatgcaaaaggaggatttttaaaaatggctaaaaagtttttatcaatggatggtaatactgctgcagcgcacgttgcgtatgcgtttactgaagtagcaagtatttatccaattacaccttcatctccaatggctgaaaatgcggaagcatggtctgcccaaggtaaaaaaaatatctttggttcacctgttaatgtaattgaaatgcaatcagaagccggagctgctggtgctgtccatggggcgttacaaggtggtgcacttgcaactacttttactgcgtctcaaggtttattattgatgattcctaacttatacaagattgctggggaattattacctggtgtattccatgtatcagcaagagcacttgcaacaagagcattaaatatttttggtgatcatcaagatatttatgcttgtcgccaagttggaatgccaatgatttgttcacactcagttcaagaagtaatggatttaggaggaattgcacatttaacggcaattaaatcatctgttcctgtaatgcacttctttgatggatttagaacatctcatgaaattcaaaaagtagaagtaatggattatgatgtattagaaagtcttttagataaagaggctcttgctaaatacaagaaaaatgcaatgaatccacacactaacccaattgagcgcggtggggctgaaaatgatgatatttatttccaaggtcgtgaagctcaaaacaagcattatgatgcagtggtagaagtagttgctgattatatgaaaaagatttctgaaattaccggtagagaatatgctccatttacatattatggggcacctgatgcagcaagagtaatcgttgcaatgggatcagtaacagaaacaattaaagaaacaattgatgaaatgaaccgtcgcggtgatcgcgtaggtttaattaaagtacatctatatcgtcctttctctgccaaatacttattaaaagtattacctaatacagtggaaaaagtagctgttctagatcgtactaaagaaatgggtgctactggagagcctttatacttagatgttgttagtgtccttaaagacgttaaacatgtaagagcaattgttggtggacgttatggtatgggttctaaagatactactcctcgtcaaatcaaagcagtatatgatcatttattagaggatgctccatttacttcatttacaattggtattaatgatgatgtaactaatctatcattaaaagaggatcctgaatttaatgttgatgctgattatacagcatgtctattttatggtttaggttcagatggtactgtttcagctaataaatcttcaataaaaatcattggggatcatactgatttatattcacaagcttattttgcttatgattctaaaaaagctggaggggcaacacgctctaatttacgctttgggaatactccaatcagagctacttattatgtaaataatgcggattttatttcttgttcattagacaactatgtaattaaatatgatatgttaaaaaatcttaaagatggtggaacattcttattaaatacagagttctcaaaagaagaaattattgattatttaccaaatcgagtaaaaaaacaattagcagataaaaaggctaaattctatataattaatgccaataaaattgctggcgaaattggtatgggaagaagaactaatacaattcttcaatctgcattctttgcattaaatccccaaatcttaccaattgaaaaagctgttgaatatatgaaagaaatggcaaagaaaacatatagtaaaaaaggtgatgctattgtccaacttaactacaaagcaattgatgcaggtaaagacgcaattgaagaagtagctgttgataattcttggtctgatttaacagtaactgcaactagaagtactactggagatgaacattttgatgaatttgtttcagtaatcaatagtttagatggttatgatttacctgtttctgctttcatggataaattagatggttcaatgaaatcaggagtggcaatcaaagaaaagcgtgcaattgcaactgaagttcctcgttggaataaagataactgtattcaatgtaataactgtgtaatggtttgccctcatgcaacgatcagagcgttcttgcttgatgaagaagaaatggctaatttaccagaaaacattggtgatgatgttttagttccaatgggtaaagatatgggtggattagtatatcgtatccaagtttcaccggataactgtgttggatgtggtttatgtgttactgaatgtccaggtaagaaaggtgaaaaagctcttgaaatggttagtgtgaaagatgaattagtacatgctccattagctgattacatgtatgctaatgttaaatatcgtgatgataagtatccattaactacagctaaaggtgttggtttcatgagaccgtattttgaagtttcaggtgcttgtggtggatgtggtgaaacaccatactatcgtttggcttcacaattatttggtaaggatatgatgattgctaatgctactggatgtagttcaatttatagtggttctactccttctacaccttgtgcgattgatggaaatggtcaaggaccagcatgggctaactcattattcgaagataatgctgaatttggtttcggaatgaaattagctgaaaattataaagttgggcatctattacgtattattgaagaaaataaagatgcttgtgaaccggaactgaaggctttattggaagagtatgttgaaatcaatggtgatcgcgctaaagaaagagagcttgtgcctcaaatcatgactgcggttaaagcttcaagcaacgaagcaattaaagaattgttaaatcatgaaggagatatggtaagtaaatctcaatggatcattggtggtgatggatgggcttatgatatcggctatggtggattagatcatgttattgcaagtaaccaaaatgttaatattttagtacttgatactgaagtatattctaatacaggcggacaatcttctaaatcatctcaagctggatcaatcgccaaatttactgctgggggtaaatcagctgctaaaaaagatttagcacaaatcgctatggcatatggacatgtttatgttgctcaagttgctatgggagcaaatcctgtacaaacaattaaagcattcaaagaagctgaagcttataatggaccttctttaatcattgcttactctccatgtatggaacatggtattaaaggtggtcttgcaaatcatcaaagacaacaaaaagatgctgtatcttgtggatacttcaacttattgagatatgatcctcgtcttgaagatgcaggaaagaatcctttgcaagttgattctaaagcaccagactttgataaatttaaagatttcttgttatctgaaaaccgttttgcacaattgttaaaggttaatccagaacatgcggaggcattaatggagaaatgtttagctgatgctaaaaaacgtcgtttaagattagatagaatggcataaaaagtttaaatcagaggaaaaatcctctgattttttcttattcgactgcaaatatagttgattattacactgttttttggaaactaaataaaaaaataaaaaaaatgtataaaattctttacaagagcaaatattagtgatagaataatcatgcactcgagataagagtggagatcattgaaaactaaacagaattaagaaacacacgtcaatatccagaaggataaaaaagaaaaaagagctaaacgtgaaatatgcgccgctagttattagaagtggcggtaattaccaagatgagggaacattaacaacagttcaagatcctgttacaataaatttgaatattaagtggatggatgtaggtgattttgaattaagaaaaacaaatgatacaggaaaattaattgacggttcagaattctcattaaaacatactacacttgattttgaaaagaaactagttgtcaaggatggtaaattatctatgactggattaccagtcggagagtacctattaactgaaacaaaagtacctgatggtcatgcggttcttcaaaagacgtttcaggtaacagttaataaagatcagacaacagaacagatcgttgtcaataaattaagaccaacaggtacgttagagataaataagtcattagaagcttctaatgaaaatgcagtaaataaagctgattatgatttaacaaaagtaaaattcaagattactgcaaaccaagatatttatgatagtgtttctttagaaaaattatattctaaaggagatgcagtcacagtaggaagcggtaaggggtcaaatgaagatattgttaagttgataaatggaaatgaattaggaaatggtatttattcatgtgatataaatggtaagttatctttatctggattgccaatggggacatataatgtggaagaaactgcctgcccagatggttttgttttagataaagaagtcaaaacggtacagtttgcacagcaggattttgttacgttaacttacacttcttcattaaatataaataatgaattaacaaaaacagttttcagtaagacagatgctgatggcaataatctttatggtgttccaatggaaatcgtagatgccaaaactggtgaacaagtttataactggatcacagatgataatgatctagaaatcgacggattgccaactggtgattatatttggcgtgaggtaaatgctccagaaggttatgttttagcaaaacctatcgagttcactgtcaaagatggagatattcaggatattgaaatgaagaatttcagtgttgagtttgcgaaaaacggaaacgacggcaacaaacttttaaaaggaggagaattccaggtaacaagtactaaaactaaacaggtcattgataaatggacaagcggtgaacatgttttcgatgtcagtgaagatatgaaagctaagctgatggccggtgaaacagtaagtgatatgtatgttgatattgaagatgattcaagtacatattacaggatttctaaaaatgcagatagagatgattatagacttttaatgcaggcaaatggtgaaactaaatattataacatcgatatcaacggtgatgaaacaacacatatgattagaggtacagttgaagatcaggaatatgttatcacagaactaaagagtccagacggttatgcaacagccgagccagttacctttaaaacaaatgaaaataaaaatttgactgttgaaatgacagatgaaatcactcaattagaattttataaaaaggatataacttcgcaagaggagcttgaaggtgcaactttgcaaatcaaagataaaaacggaaatattgtagatgaatgggtatctggaaaaacaccacataaaattactggattaactgttggtcaaacatatacaatgatagaagtaattgcaccagcaaattataaaattgcacaaaataaagaatttacagttagtgatactggaaaagttcaaaaaataacaatgtatgatgaactgatgcctgttgctaaaaaggtaaaaactgctgatgatatgcatataggaatgtatatgatgcttggtggtctatcagcattgtcaattggaatgtttatgtctaacagaaataaaaaaatgcataaaaattaattaaaaggcgatctaataaatcgcctttttcacctggtaaatttaccaggatggagggatttatgataaaaaattctaaaattattatgaaaaataagaaattaaagatagctttaatagttcttgtatgtctcggtttgacggtgtttgggtatatagcttataaatatgattttagagtagcttatacactgcttctttcaattattgttagcctaattccagtggctgcagggatttttattatacgattgtcattcaaattctttataaaagaaatgccgggtattataaatgattttgttaagataaaaactatttttaagaaagcgtttatgaaatgaaaataactaatcatagtgatataaaaagattcagtaaaatcgaatttttagtatacgaatacgtaaatctaatggcgttagttaatccggctgtcggttatttatctgaagatgcagtaaagttttttattatgtattcaatcgacacatatgatgatagaaataacagcagttacacaactatgaatgaatctgtatatacacttgagaaaagaattgaaaatggagattataaagataatcgaaagttattggacagatttaatcattttaaacagatactgaaggatactgagcctctatatttgaaagtaaatgatgaaaagaaagaaaaaagtcgatggacaacaataacgttcacgaaaaatcagcttgggaaaacatacatggctaacggtagagaggtttgtaatattcgtttaccgattggatgcaattatgaaagatatgcgctaacagttccaaaatcattaataagtgaaagcaattattccaatacaatgtactttaggactactgaaaattttattcattctattacaacgtttgatgataaaacaaaatcgtggttaaaagtggaattagatacagatacattaaagaaagagatgcactcaatatttaaaaatcataaaaaagatacaaacatcaataaaactgaattagaaaaaataaacaagaatagttgtgcgagaagtcgatagataaaaaaggagggtttttaatgcaaaatattttaattgtaaagagctgtgattttgtatattcacctatgttctcttgtgaagatgttgaccctgcatatcagcaggcttttattaagccgaatttctattttgttgatgatagtaagttgaatttaaagattgatatttcagttggtaaaaataagacagattatgattttaatatgcttattaattatgaagttgatttagatgaatgctacagtacatcaaaaaaacctaaacatgaaatagttaaggaaatcatgaaagaatttgatatattagatggatgtagaactttggtagaacagcagattgaaatgtcaaagaaattgaatctgcatttaaaaaacaacataaaaaatacaagagttaaaaatctattaaaaggaggacattaattaaatgataaaaaaaatcaaatataaattatcaggatttataacgatgctgtcacttttgttttttaagataaactacatatatgctataaaggcaccatctactgaggatggaaagaaaatagctaaaccatggatagatgggtttattacattttgtcagtgggcaatggttggagtatttgtaggttttgtaatatttaatgcggtaaggtattatcagttatcacagcaggaaagagaaagaacaagtttttgggacacagtaaaaaaggggttctatatcctggtatttgcagagttaattgttcctattttatcaatatttgggctaagctggtaaatttaccagcttttttactgaaaggaggaagcaaatatggatcttttagatgttgaaggtctaattagagatctgctgtgggcaatgtgcaatctagtccttaacattgtcgatgcactatatgaaatagctaaaagaatatgctctcttgatctaactaaaattgattttatatggcagtggtatgatgtgctggttgtattttttgtgctatttttattgtttagaatttttaaggttttttttaagtcgtatatagatcaggattttatgcagagacttaatgtaggaaaagttatggttatgctttttgtatcaatatttagcttttcaatgtttccgtacggttttgcttatttaagtgatatatcaaacagtgcgattgaaaatgtagcagtatttacaaacagttcccctgatgctagtttcagcagtatattagttcagcaggcaagtgttgatatttcggcagatctaagtaaaaatgctgatgatattaataatttaaaaaaatggaagaatgagcataaaaaaataagtgagtcaaagtttaattcgttcatagctgattttgattgggcggaggcactggtaggaaaatactcatcaagcaaaatggttattatttcttcagctattgctaataaccttagcagtatcagcgaacttacgtataaacagtatagtgattattatgataagacatatggcgaaaatattgatataaataagattgatattaatgagtgttatgaacttgatgatggtgtaccagttttaggtgatattcctgttgcaaactggtggtttggtgcaacacagatatattacttttttccaagttacagttcactgttttttggattaatggcttctgtttctgcattgttcatgtttttaccaatatgtttacaaatggctgttagagtcatagggatgatattaaagataatgctttccccctatgctttgagcagtcttgtagatcctgaaagcaactcgtttaaggtgtggtctaaatcattactctctgatctactgttaaatttttttcaactgtattctatgattttaatatttacactgtattcatcaagtgatttagacaaggctataggtgctactggttacggtatgtttgtgaagctttttttgtttttaggaggtctgttggctgttgtcaaggcaccagctggtattactgaaataattggaggcggagagcttggtgcagccagttcggctcaggggtttatgggattgctggcagcagcaggatttattatgcatcctaaacagtcacttcaaatgaggcttaatcccgcatcactttatgggggtagccgacaaggaggcagattttctagaaacggcaactcggaggacttaggtgagaacggattaaatgaaggtgaaaatattgatactggatttaatcaaaatggtagtatgggtgaaggtgctgatactggatttaatcagaaagatagttctaatgagcagtttgatagttatgggaataatatgagcagtgaggaagaactgggagctgatggtaatctaactggaggtagtggaaaaagtgaaaattcatacagtacatcgagttcttcaccaacagagctacagctggattctgcaaaatattatggcatagagggtgctgaaaaaatgtcacagcagcaattgaaacaggaatttaataaaagaggatatggcagttcttttcctgaacagcctggttataatattgatgcaggaattggcaacagtaaagttaatattgataatgcttcgagtaataattcggttaaaccagcttcacaaaactctctattgaatgaccatagtttaaataaggataggaggttttaaaaatgaaatttatagttccgcagaattttaaaaatggacgactgataatgaaacgctatagattgtttgacttggttatgcttatctcagctgttggtttttctttagtggtgtttattgcggtagtacagtcaggcataggtcgaaatgggataatattctttttcgcctttttttctattttaatttttataacttttattttaacgatgggtgcaggaataaatcataacatactggaactaatcttaactattaaggactactataaaactgagaagaaatatgaatgggcaggtagaatatatgcagatgaggaaaacttcaaaaaagaacagaaataaaaagaaaaaagtaaaattgacaaagagtgataaaaaaataatcaaggaaagaagaaaagtcagatatacaacacttgactggatgagtttggaagaaattaatcctgatcattgtgttattgttgaatttggtaatcgatttattttaaaagggattagaataatgcctagaaatatttatctgttagatgacaaaacattaggcagtataatacaaggcttcaatgtttttttaaataaggagaaaaggcgactgtactggaagtttgtaaaaagtgagcctaacatgattaaacaaaatagacatcttattgatttgtatgaagacgaagatgatgaacgtataaaaaggtttatccagtatgaattagaaaagaatgaatggtttatgtcaagttttaatgaaatgtcattttatattcttatattagaaccggaaaaatacattgataaacattttcaggatttatgtaattatttcaaatctacccggatgcagtttgaaatagcaaaaaagaaagattttcaaaatatgatctatgctgattttgataatagagatatcagtgattactatatacctaaactatatagtgaagaatttaatgtaactaaaggagaggaaggtacagatgaagagttttaatgatatgaaaaatttaatgttcaagtcacgtgcagtccctcgtggatttcatgaatatgctaattattatgtaattggtgataaatttcatcgtgctatgacatttacaataactaaagattttgatgaagggtttttaggaatgtttgtagctggtcagaattatcgtgtagaaatggttacagaaccatcaaaggctaaaatatccaactatatgaaaacggttgtaaaagatatggagcaggagtacagtaaaactaccgatcgaattcaaagggctgaattaagagagcagatggacggatataatgcgtatatcagagagcttgtaagaaaaagggatgctacattaaattgtataattacagtgtttatagaagcgaatacattagaagaattggatgagcgaacttatgatctggataaactgttcagtacatataatgttgaggtaagagctgaacgttttttacagcagagaatattgaaatgctcctcaccgttctttgaaagtgacggttttagaaaagaagccagtcaaaatattgggcagcttctatcaacgcagacagtaagtggtttgtacccgtttacttttgatacattggatgatgaaaaagggatgctgctaggggttgaatcttctcaaaaagggatggtatgttttgatcagtttctttatttaaacaatccagctaaagctaaaaaatataaaagactaaacggcaatcttattattataggtgagtctggatcaggtaaaacaactgcgatggatctgattttaatgtctcatatatgtcatactagaaaagtaatttggattgatcctgaaaataaaaaccgtactattataaaacaggcaggaggctcttattttaatcttggtacgaaaaatgcaagaataaatatttttgatttaaagccgatttcatgcgatgaagatgaagaagacgaagttgataaatacgataccagattggcaatatacaatgttgttgaggatattaaaattgtttttagatatttatctaaagatatcagtgaaggtgctctggatattttaggagagctggtactagaggcctacgaaactgtaggtgtgaatataaacgaatcttttcaatatttaaaaaacactgattatccgacttttagcgttttttcagcaattgtagatgagcatatagaaaagtttgaaaaatcgaacatagttaacgatgaatatacagctcttaaagaaattagaatcaaattaaaacctatatgtactgagtgggctagatatttggatgggcatacgacaataactgaggatgagatgaaaaatcctttttttgcatttggaactaaagtattttttaatttaactccaggattaaaaaatgcgctaatgcatattatatttcaatatgcatgggggttatgcctggatgaaacgagcgaatcggttttagctgttgatgaggcacatatgtttgttttggctggtgaaactgcaaagatgattgaacagtttcaacgacgttctaggaagtatcataatgtaactattttaggtacacaggagcctcatgacttcgcagatccgagggttttggcagaaggtaaagctatttttaataatgcaagctataagcttattttaggattagacaaagatgctaccaaagatttaaggaaacttactgcattatcagataatgagattaaaaggatagcaagattttcacaaggggatgcaatactgatagcaggaaataaacgcttgccgatagaaataaaagctactccagatcagcttgcattgatgagataaatgaaagctctgaagtatacagtagcttctttttttactttttttttagttcttgtcctaattgtcgcatgtatatctgggggtaaaagtaaaacagaggaagtggattttgaaggtggcaatactagagatttatttgttgcaaaggcaatagatgaatataatgctgttaatggtgccgttggcggtgacaagtatagaaaatggtacactggtagtgctgatggagctaactggtgtgcgacctttgtttcttggatagcggatcggtgtgggctgattgatgctaaagttattcctaaatatcaggggtgtgatgccggtgttgattggttcaagaaaaaaagtgaatttcaatatacccctagatatgggggaaaaagtatagtcccttcgccaggagacattatttttttctgtaaaggaaataaaaacgattcaacgcatacaggaattgtaatagatgttacagataatacagtccatacaatcgaaggtaactcgagcaatacggtaaagcgtaattcttataaaacggacagcaagtccattttaggatacggaattcctgcatttccaaattcaatttcaaacggagttagtggaatgctttctgaggaatttaaatactttgcaaaatatgaaagtagctgtaattatgatcagggatttagcagttctgatgactatcatgcactgggatattaccagtttgataacagatacgatcttcaaaaattcttaaaatactgttatcagtcagataataataaatacgcttgttttgaggcatatttaagctgttctaaagcatctttaagaaataataagggattagaaaaagcatggcatacagcttattctaatgatccaaaagattttgcgaataagcaggatcaatttgaatacgataattactatataccgatagaaaatgcattaaaatcattaggaatagatttatcgtcgagaagagattgcattaaaggccttgtctgtggtatggctaatctttttggaaattctggtgctaaaaggcttataaaaaattccggtgttactaatgatctgggcgacaaagagtttgtaactaagctgtgtgattatcttgtgtcatattgtccaaaacattatgcatatggaaaatcatatgcaaacaggtataaaaatgaaaaaaacgactgtttaaggtatatttctaattaatatgtgaatattaaacatatatatgttataatatatgtacgataggaacggtgatatgatgtgtttattagaaaataaagttgaagagtactataaattaaatggtgaatacatggtttatagtgatatgctggagtatggatttactaaaagagagataagacggctggttgaaaaagaacttttaagaaaacttgttaaaggactgtatatttataaaaacgaattagaagatgaattttttgtctatcagtttgcaaataaaaatatgatctatagtcacgaaacagcgtgctatttacatggactaacaacagtaattccatccagatgcaatgtaacaacatattcaggatgccatttaaggaataatcgtttaaaagtatcgtatgtaaaaaaagaactgctgcatgtaggggcagttgaacatattgattattttggtaataaaattattgtctatgattgtgaaagaactatttgtgatctgatcagaaataaaaagaaagtagatacacaggtatactatcagtcattgcagtcatattttaataataaaaaattagatatgagaaaattgagcaaatatggaaaattatttaatgtagaaagtgaaatcgcagaaatttatagtctgtataaaagtgcatagaggagaaattatggcatataaaaatatagatcagtggaaaaacggaatgataaaatatgcaaaagaaaagaatatggatttaagagatgttcagcagcgctttattcttgaagaatttgcagagaaaataagtaattctaagtacagggacagtctgattattaagggaggttttgtcgtcagcaatttattaggttttgaaaatagaaccaccttagatatggatgctacggtaaattctacggtttattctgtagaggaaataaataatatgataactgatattatcgaagaagatattacaaaatcattttttgattatagaataggtgatattaaagaagggcagtctgatgatggatatccaggctattcagtttctattttagcgctaaaagataagaccaggttaaacttgaaaattgatatttcaaataatacattaatttatccagaggcaatagagcatacttttatcagtttattcagtgataaaaaaataaatgtatgtacttatgcagttgaaaatataattgcagaaaaaatcgaaacaactcttgatcgaggtatatataataccagaatgagggatttatttgatgtttataatcttttaactcaaaaagatattagtatagatatgaatgtcttaatagattcatttgtaaatgtttccaaaagtagaaatacattgaataatatttatgattacgaggagcttatcagtgaattaagtgagtcagctgtctttaaagaaaatttcaacagatttaaaaaaattaaggaaattgaagatgtctctcttgaagacattttcacagtttttaagggtgttattgaaaaaattgatgtcaatcaatttataaattcacgttctagatagataaattagtataggagaagatatgattattgatagaaaatatgctgtaattaaatattttgttattggattcatactgttgataattatcattgccagtatattttattttactggcaatgaggacagtaaaacaaaatataagtataaatatcttaatgaggatcaaattacatttgcatctgatgaacaagttgatgattacaaaataatgttagaaaggtatttagaaaaaaataaatatagtgatgttgaaacagtaaagttttataacaggacttttaaggaagataattatgtttatttttactgtttgctggatgatgaattcaaaacattgttagaatgtaaatatgataaaagtgaggaaaaatttttaaattattttgaatgggttggagataagtatgatgatagtactgaggcacccgcaagtaaaattacttatctggaaattgttgataaagaatcatatgaaagtaaaaaatttgatgaggaaatagaaaatagggaacctgatgaaaatatagactcagattaaaatagcaattatgtatagatcctggtaaaaattaccaggatttttagattggggtagaaagtatgttgacgttctattttattataaaaaagaatttgatttgaaatttcaaaatggatttataagtattttctaaacatagtatatatactgaaggtatatatgatctatttgtaatagagacaggtgataaccgaataagtaaaaaataaaaagaatagatattaagtaattaaataatcgtctttcaaataactgtaaaagatgataatgtggaggaaatatgaataagaaattaataaacagaattaagaaactggaagaaaaaaaagaacagttattaacacaaacaagtgaaattgatgtggaattaaaaaaattatatgaactgaaaaaagaagatgagaatctacagaaaaagagaatgtgctttgaagaaaagctggacaatattttggtaaaagcaaaaaagccggatgaaaagtcaatgcaaagaaatctatgtgaagatggggaaaatgtaaatgacattcaataaaataacatattcattgtatcaaaaagttaaatacctgattgatgccgcttatccaaatattgacgaaaatgttattggaaactataaaaaaataaatatagttttatcaaaaaagacattaaaacaaaatgagaaatatgaagacagaaagtgtattatttataatttatatcgccaggaaagtgaactgtcaaattctcttttaatttgtttagcgcaccatattgattatttagtgagaggtgaaacaaaaaatgatagtgaatttaataaaatttacatccatatattacacactgcgattaatgaaaaaatggtcaaatatgatgaattaaagcgaacagatgattataaaaataaaaagttgattcaaaaagccctggattcatactgggaaagtaataaaaaatttgatacagtttatttagaaatttataattgttatgaaataaaaagtgatttaaaaagagatggatttgtatacaatgaatattatcagtgttggcaaaaagaagtaaaaacaaataatatttccacgcaaaaagattattgttttaatttaaagagtgatataatttttaatattcgagaaaaaaatcatattatttttacactttatggaatgatttgtgttacgggaaatacatattttgcaaaagatattttaaagaaaaataaatactttttcaaagaaaactgttggcaaaagaaaataaaatcaagtaattttttgaaagaaaaacgtaatttggaaagacagttaccaccggcacagggaataaagattgagatggaatattaaaaaagtaatcaatgttacaatgaaaaactaaacaaagacagttcctataaaagggaggagtacgaggagggtcaccctcctcggtgggttaaaatttataaaaaggaggtgtcgagaggaggaaaacatttcctccttcgtggcacttttttaaaatcagaatagtattaaaaatctttaaaattagctatcattttcgaaaataaatctatataattataagaacagggagacatgtatgaacaatattgaaaagttaaaaaatgaattaattgaacagagaaacacaaaatttcctggtaatatatatcatgtcacacaagtattatttgcatataattcaaacaaaattgagggcagtagattaactgaagaacagactgaaatgatttttgaaaccaattcttttattgctaaggattatgatgtaattaagacagatgatataactgaagcagttaatcacttcagactatttgattatatattggatgtgattgataaacctttaactaaggaaatgattatagagatgaataaaattataaagcgtggcacatccgatgagtttaatccaaggtataatgttggaggatttaaagtgctgccaaatgttattggattaacaaatgtaatcaaaacatcaagaccagaaaatgttgaaaatgatataaatgatttgctttttgagtatgaaaatagaagaaatattgatatagaagatatcatagattttcatttgaaatttgaacgtattcatccttttggagatggtaatggcagagttggtcgtgcaattatgtttaaggaatgtttacgaaagaacattataccttttgttattcttgatcagcataaggcgtattacttgcgtggattaagagaatatgatcgagataaaaatttcctaattgatacgtgtctaaatgagcaggatatttataaggaattgtgcaaacagctgttaaatatgaattttgaaaatggtaaaacaagataaatacaatcatcaggtactttgttgatggctgtgtttttatttgatatttagattaactgcaatacataaggtgcaatacagtcggtttcttaccaggttaagagaaagatttatacaatttaaaaaaattgtattgcatctttcgcttgaacaactgagcaacgctcagtttttttgtataaaaatgtattgcatttttgtaatacgtatgaaatacaaaaaaagcctacaatgcaatacaggtaaaatagtatcgttttatagaaggagtgaataaaaatggcaatggaagctgtatcgtttaggtttgataatgaaacattatttaaactgagcgaattaacaaaattttataaaagtaatgacaagaggataagtaaaacaaaagttatggcagatataatttcgactgcttatgacaatataaatacctctcaaaaaaagtgttataataatgagaatgaaatagtttatagagaaatagtagaactggaatatacgataatcaagttattaactactaatttaaaagatgttgataatatagaagaaatcaaacggataataaacgccaaatcaagatttcaaatatatgtggaggataaattgaatgaaaaaaatagcaatatgtattcggatagatagcgatatagacaataaaattaattatcttattaatgataaaaaaaatgaacagtcaaaatataatgatgatacaaatgtaactaaaactgacattataacagatgcagttgaacttcttttttcgtatcgaactagagatgcattcagattattaaataaagaacaagagacatatttgaagggagtgctaaagcaatatcaaagtcttaataatgaattttttaataatctgatatttgaaattcttattttgaaacaattgatagttagcactaatggcataacagaaagtcaattggatgaaacggtaaaaaaagttcttgataatattacaaatgcaaatagcaactgatcatgtgctgttaaagataaagaggaataacaatagcaataaacaaaggtagaatatttgttcttcttttgttgagaggtggtattttatgacaaagtctaatgcaccaattataggtgatgtgagatttttaaaatatggtgctgatgcacctgatgaatcaagattcaaaggaaagataagtacagagtctctaatcggtttttttgagtatactgaacaggaagaaaagaatgtagattgcaaagatgaaagtttacatgatggtggtttctttggttatacatctgataaaaacgaatatacattttcttctatgggatggctagataaaaataaacacgataaatttagaagagaattgagaaaggctttttctaaacctggagatttatggtgggatactgtagtatctgtttcaagttttgagcagcttagtgaatttggaattgtcactgctgatgactggtatgatatatgtctaaaagcactaccggaagtttttaaaacaatgaatttagaatatgataatatgctatggtggggaaattatcatatcgatacaactcatccgcatattcatctgtgctttcttgaaaaagataaaacacgtgaaagaggtaagctgacaccaacagaattaagaaagtttaaatctacatttattaaagaaatacttaaacgtgcagtgttcgaaaaagaattaaaagtaagtgttaatgaattttttaaatcaaaagatgttgattttaaaaatcttatgaatgtaattgacagcagagtacttgaaaaagaaaaagtttcaatgaatgaactttataagattttacccaaacaaggcaggctggcatataattcatgtaatatgcttccttacaaaaaattaattgatagtctgattgataaagttctgagtgatgctgacgttcaaaaggaatttaatatttatctatcaaaattagagcagcttgaagatctgatgaatagacaggttaatacaaatatatcaaatattaaatctacagaacttgaaaaacttcgttcacaaataggtaatcatatattgaaaaattataagcgcaagataacaaataaaagtaagaaaaaaataaacataaatgatggcagtttagaaaaatcaatgattgataatgtagagcaaaatatcattgaaaatagtaatactgatgttgttgatgatttaattgagaattattcagatattttggaaactgctgatagagcagtaaatgaaaatgagttcattttagaatggagtcaaagctataaagaaggagcaaacctattttacagcagtaaaaatgaaagtgaactgcatttagctgagcagatgcttttaagtgaggctggtagaaataatgttcttgcactagaattgcttggaaaattatattcatctaataaattagacgaaaagtccaatattatgtacaaaagatctttagaaggttttaagtgtatttttgatgaaaatataaacgataaatttattagaagctatgcaggataccgcttaggtaagttttatttgtatggcactggaactgagattaattatgaaaatgctatgaaatattttgaaagcagcaataataaatacgcttattattctttaggaagaatgtatcaatatggtttgggtattgaaaaaaatgacgaaatggcactttattattttgaaaaatcttctgaaggaaataacgcttatgccaactatgaagttgcacatcattatgaaaaaggtattgcctgtaaggttgatttagaaaaagctgaaactcattataagactgcttacaatgagtttaaatcaatggttgaaaaacatggagatgataacttgttataccgtcttggccagatgacctatcttggtaaagggtgtggacaggatatcaataaagcagtcgaatatttgcaacgtgctgtaaagtttgaaaatactaatgcaaaactattgttggctcagatatacttaaaagaaggatatattggaatgtatgagacagcacttaagtatctccatgatgttaataatgatacctccaactatttacttgggaacatatattgtaacggggaaattgtaaaaaaggattggactaaggcagttcagtactttaataaatgcaagactaatgagtatgcgtattataaaatgtatattatttataaaaagaataatcaaccggatagagcgttaaaatatttaaataaatctgttgaaataggatatgaatatgcaaagatagcattagcgaaagaatatatggatggcaaatatttagataaggatatatgtaaggcaattaaattgttaaagcaaagtaataatagttatgcacaatatttacttggcaaaatttatttaactggcgatggagtaaaagcaaataataatcttgctaaagagtatttaaaaaagtccgctaatcagggaaatgaatatgctcaataccttttaaagcacagtaatagttatcaaaaaacatacaggacgagatattcattgaaaagattgtctaatcttagtgccaggtattgccgtattaaccaggaattggcgcataaagaatattataaatggctgagagataatggtttgcttagtgaacaagaggggagggaatttaatgaaaaaaatagtcgttagtattatttcatttgtattaaccaaagtagttgttgattttataggtatgcagttaattaagttatttgtattaaatgattttgattttaaatatattttcgattacagcttgttattcctagatggtaacaagttttttttattattatctttttttgcttttttagtatggtttgaaattatttacggaatattttttagagatgatgtcaaaaaaagacgacttacaaaaaatgaacagcttaaatacgctaaaattgatagaacaagagatgtaaagaaatctttactaagagttgattttaataaaactggacttgttgaacatagaatgtcaaaacaagcattaaaaatcaaaatgacaccaattattgataaaataaataaaaggacaaaagatatccctatcttaaataatacacaaaaggtattgattcctgctaaatgttggaatattggtgataagaaatgttatgtacgtgctggatttccaattacaggaaatagaaaatgtatttatgttgatccaggtgatgttcataatttggttataggtactactggatcaggaaaaacatggacttttgtaaatgaatatttagagttgtgtgctatgtgtggagaaagtgtagtcgtgaatgatcctaagggagaactcgcaaaacataccttacagaaatttaaagataatgggttcaacactgttgtaataaattttgttgatcctgaatttagcaactgctggaatccatttaaacttgcatttgatgaatggaaaaaagcagatgaaatatatataaaaaaatatgaagaatggaaaattaaaaataaaaatggaatattagagtatgaattgcttgggctggatacaaaagaaattgaaaataaattaagaaaacccaagccaaattattctaaagcaatggacttattaagagatgcctgcaatacaatctgtttagaggaaaatcctaaagatccaatctggactgaaacggctagggatatgcttgttggctgcggtgccctaatgtgcgaagagggtaaggtggagtacatgaatgcgacttcattcaaaaaaattattgaaattggaaagaagcagctgccaggtataagaaattctaaaacaatactgaaggcttttcttgactcggaaagaagtataaccgactacagtgttaattatctggaagggtatgtaggatcaagtggagatacatcgactggatttgaatctcagtttaacaacaagttgagtattttgacagctaatgaagatattcaaagaataacaagtcatagtgactttgattttcgtcaaatcggtagtgaaaagactgctattttcctgattgttcatgatgaaaagaaaacatactatcctttggttacactgtttatcaaacaactatatgaagtgcttgtacgtactgcaagggatgagattaatctaagattaaaagtacctattaatttgattttagatgaatttggtaatatgccagcattacctgatgttgatgcaatgttgacagctgctagatcacgtggtattagactaacagcaattattcaaggactagaacaactggaaaaacattatggaaaaatggcggaaacacttaaaggtaattttacaaatacaatttatctactatctggttctgatagcacggttgaagaaatatctaaaaaggcaggcagtgagcgtgtttggaataaggatatgagaaaatatgaagatcaacgtatttttaccccggaacgtcttaaggattttaaaatgggagaaattttgtttcttagacagagacataagaatccttactacactaggttacttccgtatgataaatacgtattttttgataagagtaagttttatttgaatttacctatagttgaaaagccagatgtagaattatttaacattgaatatgaatatctaaaaagacatggtaaagcagataaatttgataaatttgcaagaaattaaggagtgagtaaaaatgagctgggatgaaaaagaacaagctaaaaaaattagagaagaatataatatcaaatacaataattatatgactttaaacctggaacaattaaatctatgtgaagataaagaaactaatgcaagtgactttgagtgtgagtcaagaacatttgctgatcgcataattgtagggaaagatagaaaaagatttgcggtcaagaatagttattttgaatacattaattttagaaagtttgaatgtgaagaaacagtatttattaattgttttttcaagggagttaaatttatagattgtgatgtaccaaatattaaatttattaattgtaattttgatgactttgagattgtaagatctaattttattggaagtatattttctgggtgcttattcattagaagtagggtcgaagaaagtactttggatgagagtatatttccgctttcaaattattacgatatagaaattgatacagataagagcaagcctaattattcgactgttaaaggagtattggctagtgaacaaaaagaggttagcagtatagaaacaattttaaaatcggatgaagtagtaccgattgaagtagaaaccattgaaaataagatatataagcatgaaacgattgttattgaggaattaaaaaataataaatttgtaaaatgtgagtttatcgaatgtgtttttgaaaacgataaagagacggataattatattaatgatttatcaattgaattttggaattctaattttaaaaaatgtctatttaacgcaactttttttaagaccgtttttgatggctctaattttctagaatgtagatttaaagacaagtatataagatgtagtttttgtgatactgtatggaataaaaatattcttgaagatacagcagttttcaattattcgatgattattaatgcggtattggattttgattttacatctataccagaaagaaatagaaaaaatgttggaataggtacaacagcaaatagcaaaaatattgttaataatctatcagagaaagatagacaaattgagcagctgaacaaagaaaataagctattaaaggaagagctggaaaagttagattgtaaaaagaaaaatttaatttcatttgaagagtttgatgatcaactgttaaatgaagcctttagactgattattgcacgttgtcagaggccggagcctgtagaatttgatttatggaatgagattaaggcacacattgacagtttatcagatttggattttatacagtttgttaatagtattaataactataagttgtcatcaaataatcttatagatgaggataggcaagaaaaaaatatggataaccctgataacaattatattcatgaggtcactcaagaagaaaagaaagaaaaattaccaggtttagaagatggagtggtttaatgatgactaagttagaagatttgaaacatcttgctttttcaccactacaaatgaatgttttacggaaggcagaaaaagacggattaaatcttgagtggttggctaatacaaatttagattatcttcaaatggaagaaatttatttatgcttaaaatatgatgtagatccatcttcaatatctgaccctgatataccagctgagtcgatgagatctttgcgtgaacatctgtttgaaatgcagggcgtttatgaggatgaaagaatcaaaatcaataaacaaaaaacaaagctcataattttaattgtgagttttgttttagtactttcttcactgatagcagttgtatatattaacagggattatatatcattgtactttgaagatattaacctgactttaaaagctgataaagttgaaatagggatgtcaaaatcttttaatcctagtgattacataaaagagtatgataaaaggtatgacttaacactcccaaagaataaaaaatttgaagtacctggggaatacacggttatttataaactctctaataaagtaaaatccataaaaaagaagctgattgtgaaagttattgatgatattgaaccagtcttagtgttaaataaaacgaatttaacattagagtatggtcaaaatattgatcttaaagactatattgaaaaggcagaagacaatatagatggaaatcttgtagaaaaagttgattataatcaaattgatacttctaagcccggtaatcatgttgttacttatagtgtaaaagacaaagctggtaatcatgtttcggcagagatgagtatcaatataaaagaaaagccaaaagttactgaaaaatctacaaacagtaatacagaaaataatgttactactaataaatctaataattcaaataattcaaagtcaggacaggaaaatattccttcacaatttgataaatttttttcaggtaatagtatagatgtgtataatcaagcgaattcctatgctgaagagatttttagtagtggaaaggtaaaaggattttctgtgaacccaacaggtgaagggtttcaagtcagtttttcataatatgaggaggtaagaagaatggcgttgtttgaaacagttagagatattatgtttgcagaaattatggaagccacattaacagaaatatcaaaggaacttctgagggctaatgaattgaaagaaaaggagttggcactgaaaagcaaagaattagagctattaaattctggagaatttaaatataactatatagaaagatataagcgtgctttttttgatgcatgcaatcgtttagaagaattagatagaatattgtatgaaatggatcaaactgttgaacctatgtctaatgaggagtataaagaagcaatactatcaaatattcaaaatatggataaaaatcaatatgattgtgataaaacaaaagattatgagatatcgagcaaagaatttatagattatactaatcggcttgattcagcaaaattggaagacaaagagtactataaaaagatcaatgaaaaatttggagatagctttatgtactatgatattgaggaacgactttatgtttgttacgactttttatatggcgatgttggtttacctaatatagaaacaataaaagatagagaaatggccatagaatggcttgaaggaaaaattgagatgaatgaggttatacataattcctatattagataatcctttaaaagattatatgattagattttggataaatgttaacatattcatgcacaaaaggaggtgagaatgagcatgattgtggattacaatagaagtttttgaaataggaagataatttatactgaaactgctatttgcagtttttttgtaaaaagtcatttaaattcaaagataacaaaatcgattaattaatattattcttgatggggggatttatgatgaaagaattattattcaaagagatgatagaaccatattactatagtaaaaaaggtacagttagaaattatactttaaagacatatagacaaaagattgatatacatatattacctttttttgaagatctagagattaaaaacattgataaaaaagtaattattgattggcaaaactggatgttggataggggtcaaacaattaagaatacaaataaaataagatctattttatataatattattgaatattttgttactgaggaattgatggaaaacaatccacttaataatgtaaaaaggatggttgacaattcaccaactgaagaaatgttattttggacatatgatgagtttaagaaatttataagagtagtagacgaaccagtttatagaagattttataaattcttatattatacaggttgtcgaaagagtgaggcaaaggcactgatatggaagcagattgattttaatagacatgttattgcaataacccggtcattagagcgtataaatgatgatggtacacatattgtaaacaagcctaaaaataagatgaataggcacatactgatgaataaagaattggaagatgaactttacagctattatttagatcgaaggatgcattttgattttagtatgaatgagtatgtatttggtatagataaaccacttgccgatactacaattgagaaaaaaaagaataagtattgcaatgatgcaatggtaaaacagattagaattcatgattttaggcatagtagtgcttcgttatggattagtattaatgagaacgttatggtgattagcgagagattaggacatagggataggaatcagacattaaatcgttatgcacatctttttcctaatgcacagcaaaatggtataaagaaaataaatagactatcaaatatttatgatgaagcagatattaggctaggtgcagtagttgtagattttttagaaaaattagatagtattgaaaatcctaatcagcaagagcaagaatttatagagtcatttaaagagttggtatttaaaagtaagtaagttaaattcaatttgataaatttcatggaaaaatgtataataaagaagaaaaaaagttaaaaatagtgttgtgtatcgttctacacaatggtataatatagtcaagttagagaacgaggatataaataatgggtgagtaaaatgaaaagctagactcctgtcacccgcaccagttgttaagtactctcaaatcttttatttataagaggtttgggagtttttttctttatataaataaaattgtttgaaaatttatattttaatttttgatagaaaatgaaactttaaaattgcctccataaattattaaataaaatatgaatcagactttattcattaatttattaaaaatttataataccaccattactgtgcttttaagcttttgcgatttttttacctccgcaatttctttacgaatgataatatttaatcttattttgatttgaatgctatagttttcactatttatattttacctccaaaatgactaaacaaggctatcaggcaagatatctaacatcatgtttgctgattctacttttgaaaggacatctaaatgagcttaggtatttgcagttattgtaatgcttgaatgtcctagccatttttgaacttttactagattcccatctttaatacacattcttgttgcacaagtatgtcgtaaatcatgaaaacgaacatgtattaaattgttcttttttaatattaaagaaaaatgttgggttatatatcctggtttaatatgatttcctaatttattaacatagatatagtttttatatttataattatacgcttttccttctaatttcttattttggtgcttagaataattgcagggtttaacctaaaaagctttaattttaaaggtatacggacaattttttgttgatgactatttgtcatcttttttcttatattttcctctttatttacctgatttttttattttcttttgatgttcactcacagtatatttttcatataagttttgcgaatatatgaatttgtttctagctctttcaaagttttgtagcccatttgcattactgataatttttttaatatagttgttttttccttcattggaccatttgataatcgtcttccttcaatccaaatgaatgaattcaatatttctttttcagctctacctttgagtgtttctggagtttcatcattgagtgatatgtattcttcttttattttgtatgcttcatttaaatatggattgattttgagtattctttcagttatatatgattctgctacatgtgcatttaatatatggtcatatttgtaatcatcatttttaagatcgtctttattttttaggataagacaatagcaactcttaagcagtctgtattcccttgaatctttcttttcattttgatatgtacgcattattctctttctaaaagtatttaaggaatcattaactttcttcatcacatgaaacggatcgatacaaatagtagtgttcttaaagaaaatattgcatagaagttcataatttttatacatatcaataataatgtatttgacattattacattcgcttaatgggatgctgaagaaataattatatagatcttccttccatctggattcaataatatcgattatatacttcttcttgaaatccataatcataaaaggatatttcttctttacatgtctattgaagtaaaattcatcccagcatagaattttagtaagattctttataggtatttggacatacttatcgaatatatcaataactgtagaaactgcaacatcatattttttggctgctgaagaatgggtagcggtatatggtttaagatcattaagaatattaatgacagtagtagtgtcatcacatttctgtttccggtaaatggagcattttcaacgaaagttgcattacaatttttacagacatatcttctttggttatagaagattgttgaatcaaaattaataaggattttgtgtttaagttttcttattttataatctttgacataatgagtaaaaaagccacatttgaagtttaatgataaaatctttcatgaggttcttataatattgtccgcaaacaaattataataggagaatctttttttataaaaagataactccattttaaatttaaagcaagaaaagacagaccccattaaacttttaaagcctagggactgtcccgcaattattcaatatacccttatttttagtctgattgttttttaatttgataagaagtttttcaaatattttaggtaatggatatactctataacttgttttttgctctatctttttctgcttcctcaattacctgagaatcaaaaaaggaggaaaacatccacctgatattgaatcgataatatctaaagaaatagaactagttagattcggacgcattaattttcgcaaaatcaaatctaaggcagtagtctattttacatatcgattcgattaacatgataattatatcctgtttttaaagcagtatcaatactgtacttttttgtgtacaataaatttcaataaaagaccaaaaagtagactctacatattcttattgatttcttgtttgactaacttaatggcattgccttttaggcgtggttatgatatgcagttcgttacataaaatgtaacgtattacaagaaatggctaagcaatgcaggaataagtaagggtgttataatatagaggaagaaataagtagagaggagaaagaaattgaagaaaaagaaaacaataagtaaatatgcagcatgttttcttgcccttaatatggcagcagagccaattactggattatctatatttagtcctagtgtaatcatggctcaacaacaagatgttattactgaaagtaatgatccttatttagtatcatcaaccaaggaggtaacagttagctcaactcgtgatggttcaacaggtgatttagcaacagatggatgtaatgatacacgttgggaaagtgattggcgtggtgataaagccgaatggattaaaattgatttaaagaaagcaacaaaaatcactaaaattcatttgaattgggaaggtgcgtgtgcaagtgaatatcaaatacaaatatcagatgatgatgaatcatggacgaatataaaggagataaccgatggtaaagcagggaaaattgattttgattttgatcaagtcacagcccgttttgtacgaatttatgcttcaaaaagagcaatgcctgcttatggtgtttcgttatatgaattccaaatttatggatttaatggtttatataaagtgaacttagcacaaaataaaccggctcaagcttcatcgttattagatgaatggtggatgaaagatagtgaaggaaatatcaaaccaggggaaacaccagacgctaaaaatgccgttgatggtaatacggcatctagatggcgttcaggaaatgatagtacctattttaaagaaaatacacctcaatggctctatgtagatttacaaggtttgtataaaattggacaagttaatattacttatgatagggaagcagctgcaacaatttatgatcttcaagtatctaatgatggtcaaaattggcaaacagtttatcgtcaattacgtggtaacaataaaaaacaaaagattagactatctgctacaggacgttttgttcgtgttttatgtagaagcaaatatcgtgatggctatgttgcgattaaagaattagaagtctttagacaaatggaagatgaaaaagatgttacacatacaattccagatcttcctaaaaaagaagttgtttctgttaaaaattcgaaagcaacttataattcaaatgatatctattttgctaatcaagcaagatatcctgaatatattgaagataatttaaaaaataaacctttagcttctaatgactggtggcaatcattagtgattaatgaaacgggtaatgctttatctttattacctttaaaagttaaatatgaaccaactaaaggtttaggactattaacatatagtaagtcaaaatggaataaagcagatgattatacacagggtgctgtaacagcatctaaatcagaatcaacgatggctttctatgtagaacctagtgattttgatgacagtcaagcctataacaaagtcagtggttatggtgattatcatgtaagtgttaattattatgatgctaatggtttatcaatgtccaatacttttgttaaaggatcaccttatacatattttgatttccatgataaaaagacaatctctttaaacattaatgatgaccaacatgctggtgtaaaagcctcattctttgatgaaaaaggagatattttaacagaaaaaggaaaaataacaacagatcatattggtatcaaaactgtaactggagaaaaaataaactattataatgtcaatgttccagtaaatacccaatttgaaaaaacagatacaggattaaaaataacaattaaagatgatgattcttatatgtcaattggaacaatgacagatgcaagtcaattaaatcaattctatttacatggttatgcttttgtaacagataccaatgttgcgtacagttttgatgaatccacatctaaggttacatcaagttataatttaacaactgaagttaaacgtgatggatttactgatcaatcttatcaatgtatgttccctcatcaatgggataaatatgctagtgatcaagacctaacaaagttaaatataatttatgattcacctcgtggaaatcttaaattatatgatgggaatttatttaaaatgcaagatactttctatggaatggtacctgaatttacagtaccgactaatggggaatatgatgaaaatgaattattatcatatttagataacttagatcaaggaactcagggtgacttagtcggatctgatgcttattggcaagggaaatcacttcatcctttaggtatgggggttcttgttgctgatcaaattggtaatactgaatatcgtgataagttcttaggtaagatgaaaacgattttaactgattggttaacttatagtggtgaaggagatcaagctttcttcttctatgataaaaactgggggactttatattataaagatagtgaatttggggctaatagagatatctctgaccaccattttacatatggatactttgtctttgcatgctcagtacttgctacatacgatgatgaattctatcaagattataaagaaatgattgatttaatcgttcgtgattatgcaagtccagataaaaatgataatatgttctgtcgttatcgtagttttgatccttatgaaggtcattcatgggctggtggatatgctgataatgatgatggaaataaccaagaagcaggaagtgaatcgttatttggttgggtaggtgcttatttatgggcaaccaaacgtgaagataaaaagatgagagattctgctatctttggatttacaacagaattaaatgcagtagaacattattggtttaattattatggtaacacgaatgatggtttagatcatagtggatggcctgaagattggccaagtaagattattggtcaatcttatggaagcagttatttctatggtaccttctttggtggatatccaacttatatttatggtattcactggtgtccagtgggagaatatattagttattatggtgtagataaaaaagcagcagcagatatttatcaaggtgttattgatgatacaaatggacaaaaggaagctcatccagatgttgaggattatccagatacacttaattcttggcaacatattttcttaccatttttatcactaagtgatattgatcgagcaatgcaagaattaaatcatgatacgcaatcacaagcagaaggatttaacacatactggttcttaaataatataaaagatttaggacaaagaacaactgaaatttatgctactggtggtgtttcttcttcagtatatgaaaaagaagttgatggtaaaaaacaataccaagcaatggtatggaatcctacaaatcatgatatagaagttacatttaaaaatagtgaaaataaagttgtaggaaatgcaacagtaggggcccaatcattattacgtttagatcctactcaaaaggatgccgtacaaacaaaaaaaaccattttttctgttgaaagcgatacttatgatgacactcaatacgtaaagatttcatctgatacaaaaggagcaacaatttactatacaactgatggaagcgcaccaacaacgaattcttctgtatataaaggaagaattgctgtaagcgaatcaacaacaattaaagccattgcagttaaagatgattatattaattcatcaatgaattcagtaaaaatcaatattgatacaaattgtattactaccggaatcaatcttgctacaaataaaccagtttttgcttctagtgaaaatggcaatgtggcaagtaatgctactgattataacgctaaaacaagatgggaagcagcacaaaaagatgatcaatggatttatgtagacttacaacaagaatatgatattaataaagtaaaattaagttgggaagcagcttatgctaaaggatatgaaattcaagtttcttctactcctgatgatgaggcaagctggaaaacagtttatactgaaacaaatggagacggtaattttgataaagctatctttaatccaacaaaagcaagatatgtacgtattaaaatgaatcaagctgggactgactatacttattcactttatgaaattgctgtttatgaagcgcgtaagattacaaagccacagttatcattaaaatcaggaacatatcaaggaaatcaattcttaagtgttgctagtggaacaaagggtgttcaatttagatatacaacagatggtagtgaaccaacagaaaaatctaaattatatattcctggtttgatgcttactaaagatacacaaattaaagtcaaagcatttaaaaaaggaatgattgcttctgatactgttagtggaaattatgtcattaataatggtgaagatacaggtgataaagatttatatgataaagcacctaaatttagtgtaaaagaagatgaagaaattgaagaagaattacttgctggtgaaaaaggtttatcagatactaatgaattgattagtggtaacttagcttacaataaaaatgttgttgtttcttcttcagaaaatgaaaatagtaaacaaaacattgttgatggcaatcttgattctacatggtcatctgattttagaaatgtcgataatcgtgataaagagcattgttatatagacttagaagcttcaatggacattaatcaagtaaaattacattgggttaacaatactgcaccaggtaataaatatgcaattcaagtatctgatgatgaaaaaaattggaagactgtttatatttacaatcaggcaaacaataatagtgatgatgctacagatatttgtaattttgataccatcaaagcgcgttatgtaagaatgcaaggtattaaattaggtcagggttatggttatgctttacgtgaaatggaagtaagaaattcatcagctgcacaaccatttggacaaaatgtaggtgttgatgcaatgtatgaaggaaacacttatgataatttacatgatggaaatatggatacatcaacgacattatctggtcaaggttcatttacatttgatttagctaaaacatataacattgatcgtatcacttttgatcatgaacaagctgtacaaggaacatatacagtttattattcaacagatagtgaaagttggacatctatagattcatctacattagataaaaatattgatttatcatttgatgctgctggtgcacggtatattaaagttgattataatgttgaagggtcaatcaatgttaaagaactacaagtgtatacagttggttcatctaaagatgcacaagctgacgaaatgctttatgatggcgtcgctgcaaatgcatcgacaaataatgatgcagctagaaatgttttaatagatgatggacatgtttcacgttggcaagctgatgtaaatgatcaaaatgaatggatttatatagatttaggtgaatctaaagatattaatgaattaaaattagattgggaagcagcatatgcaaaggcttatacaattcaagtatctaatgatgcctcatcttgggaagatgtttattcaacaaaagatagtaaaggtgaaaaagaaactatcaaatttgatacagtgaaggctcgttatgttaaagtacgttgtgaacaaagagcactagactatggagcttcactatattcaatgaaggctggatatgttgaaccgattgaattagatcatattttagttggacctcaagaaagtaaaattgctttaaaagataaattacaattaaattacgtattttatcctgcaaatgcgactgaccgatcaattacatttaaatcttctaatgaagaagtagcaacagtaaacgctaaaggtgttgttaccgctaaaaaactaggcgaagttacaattacagctattgctgctaacaacaaaacatatgaagttaaagtaaaagtaattggtaaaatcagtaaaccttcattaacattagatcaaaaaacatataatagtgtagatttatcatggtatgctattgaatttgccgatcattatgatgtttatgtaagtgataaagctgatggtgagtacactaaagttaatgaatcacctattaccgatacttattattctattgatcagttagctgatgggaaatactattataaagttcaagcatgtagtggtgatgctgattattcaaacagtgatttaagtagagcgcaatctattaaagtttctgttccaactgctattgatttagatgtgacttcagcgacagtaggtgtcaatcaagattatacaattcaagttaaaacaacattagatccaagtatattagtatggagtagtgataatccagatgttgctactgtaaccaatggtattgttcatgcattaaaaccagggaaagctacaattactgtttcatcaggtgttatttcaagaacatttagcttaactgtcatgggggcattagaaacaccagtattaaataaaacaactgatgataatcatgtaactttttcatggagtgctattgaaaatgcaacaagttatgaattttatcgtaaacaaaataatggtgaatatcaaaagatagcatcaactaatcaagtagcttatcaagatcaaaacttagatcctggagattatagttataaattagttgctaaaggaaatgaattttttactgattctatggatagtaatgaagtatctataagaattacgaaacaattagaagcagtaacatcaaaagcaacagtttctaaaaacactgttaaattgacatgggataaagtcaatcacgcatctaagtatcaaattttaaaagctaatgcagctggacaatatgaggaagtagcgatagtagatacaaatagttatgaagaaacaggattagatgctggaacatactcgtataaggtcgttgtctttggagacgaattctatacaacatctgaagctagtgaagcagtagaggctgttgtaagtaaagatgattctaaaggtaatgagcaaaattcagatgaatcaaaaccaggagaaatagattcacaaggaaaagaaacaatgatttctagaaatgaatctaaagattctaaaaaacagataagtaccagcacaggggatcaaacaagtttcgcatctttattaacacttggtttatcatcagttatgattgctgtagaaatgttaagaagaaaactaaataataggcgctctaaataatcgagtgctttcataaaattgctataaaatattaagggggagttctgatgataaatcagaattcccgaaactttaaaatggtttgtgtgaactatccttcgttggtagaataatatcatctaccaaaggaggatttttaatatgaaaataaatattatataaagaaagttatttatatctatagaacaaggaataatcccccctttcccccgcaaaggtatactgttctgtttggggtgagtcagtagatttttgttggaagaaatgcaagaatttcttcactgcttaattcagtacgcattaattgattataagcactcttgaaattgttttttatatattcgatgcgtttcctttgagatgtttctttgttggccatatcgcttggattgaaaacttcatcagtcttaagtatatgatagatagctaccgatatttttctggcaatggcaatgatagctcttttcttgccatggcgcttagaaatcttattgaatttattggcatagtagtctcgatctttatctttaactgctgcatgtgcaacctgtacaagacatgttttaagatgtacacctgtgcttgaaatcttaatttatttctttttaccagctgattcattgcattcgggtgtaatatcggcccacgaaactagtttgtaatatgtatctactttcagttaaagaataaaatgcctgcagagacaaatcattttcatgactatgtgtgttttacagccgcaagcggaaaggaatgtaagattattatgaataaaatttgatatttttttattacaggttttataatgacgataatgtcagtaccattgattcaaacagttaaggcagatcaaccggttggaacacaagtgataagcttatcacaacaaacgattgagacaactgtataatattgctcttgcaccgaggcttgtaacgaagaacaaatttcacagtgttcatcaactcatcatcaaataaaggtgcatcaaaaagacggctgccgttttcattctagtcgccatcattaaataatatcgattagaatatgtgagggacttatgcgtacagaagaagaaataaccaaagccattgatcaatatgcagatatggtacaaaaaatatgttttattcagatgaaacagcaatgtgatgttgacgatatttttcaaactgtttttattaaatatgcaaatggtccgcattttaacagtcctgagcatgagaaagcttgaattattcgagtcacaataaatgcatgcaaagatgtttttaaaagctggtttcgtaaaagtgttgaattcaaacaaaatattgaaatattatcagttgatgattcatatttaatctatcatcaaagttctgatttaatgcaagctgtgttatcgttaccaaatagttatcgtaatgttatttatctcttttattatgagggttataaggctgttgatatagcacatatccttcataaaaaagaaaatacgattcatacatggcttaaacgagccaaaaacaattaaaggatagattggaggtgattattttgaataacccattgaaagagcttgatcaaatctatgctagtgaagagataaagaaacaaactcttaattatgtaattaattgtaagcattattctaatttgcttcttttagtgccgttatgcgtttgtgtcttattgttcggtatatttatttttcctaaagatggcaagattgttccagtagcttatgtttcactggatattaatccaagtttagaattgcagcttgatgcaaaagacatagttattaaagtagttacctacaatcaagaggaccaaagagttatcgataaattaactcttactggtgtaaaacttcaagcagcaatacttaccttgctaagtgacgagcaatataatgattatcttcaaaatggtttattagaagtttcggtatttgctaataatcaaagcttatcatcaagccttgaaataacattaaataatttattatcaaagcagcttggaactaatcgatatcattgttcacaagttgatcaagaaactcatcataacgcttcatcacatcatatgtctgcgggtaaatatcaaattattgaaacgattatgtcttatacttcacaatattcttttgctgaacttaataagtttagtgttcaagaactgtataatattttagctatatttaatcaagaggaggttcctgaagagtgtcagccagggcataatcaagatagtcatcatagaaatcataatcagcctaaataaaaaatcataaactataatactgtttatgattttttacgagttgatttatcattgttgaaaaaattagcatatttataattataccagattttcgagtaattaaattttttgccgtttgaaaggaaaacgttatcatcgataattaaaccaaaggcaccaggttctaggtttaaaagctcttgatcttcttttgatagtggtttagcaaaaatgtatttttcagaaaagccgatcgtaagttttaaatcattaataataaaagaaaaaattgatgtttttgcaatgtcttcattaagataaggaatgatgtctttgttatagtaagtatattcaacagcaaaagggatatcatcaatatacattaatcgttttattgcataaactggagtaccaactttacattctaaatgttctgctagatcagtatcacagtcaattaatttaaaacttaaaatatcacgttctaatttttcaccgggatgttcagctgaaaaaccgattgtgttatttaatttgatagttcctttatttggttctcgaatgtaaaaaccactaccatgaatagcaaataacaatccatcattaaccagcaaattaatagcattgctgatggtgtttttactagcatcatattctttcatcagctgcccaccagtaggcagtttttttgtttcttcaaattcaccattttcaattcgtttctttaaatcaatggaaattgtttcgtactttctcataatatctcccatccttatttataaaaatatcatttaattattattttgtaaagtgtttggtaacaattttgcatatataggacaaaaaagaaaccccttacattttgtattgacactggtattaaaacgttgtattctaaaagtagataacaataaaattgtttggtaacaatcacaaaagatgtagaaaaggagtgtgaatattgataataaataaatgtgttagtagtttggggaaataaaggggataaacgaatgaaatagtgtttattttggaaaggaaactttattatgaaaaagagaggtaagattgtttcgttattagttatagtggcgatgttttttagttatattgtaccaatcaaggctcaaggaaattggcaacagcatttagatcaaactatcttgaaagtgggttatacagaggtttataaagataataaaccggtagtaccaaatgctaatctgacaattacgataactggaacgggattgggtggtaaagaatataacacagtactgattgatgaagaagcaagagaagtagaagcaacaaagcaaaatggggtaatcaatggtgacactactcaattagtgctgcaagtaccaggaacattgtcagggggtcaatatcaagtaagaacaacgattgatagtgaaagtgttacaaatggtctaattttattaaataatgttaatttaagcagtaagatcagtaccaatgttactggatattcaggagtaacaggcgatttaattgatggtattcagtgggcaatgtatacgcccgttacaaataagccaactagagaaaatccaggaatttttacatttgattatggagaggatttaatagatgtgtattctttagatctatattcaacatatggaaatgaccaaggccctaaagttgcagaaatattatattgggatgatagtagtcaaacttgggaaaatattttaaataatggcagtcgtgaatttgaatttaggtgggataagaatattgaatgtgagccatttcgaattcaatttgatcaagtttattcaactaataaaatcatgttaaaaacattagattcatatactagttgggaaaatacgaatgatattgttgaagtacaggtatggggttataaatctggagagttaccatctattcaaataagttcttcacaaggaaattatggtgtgaaaaatattgtaccaatggtaataaaaaataagaataaatctactacaataaatttagagttagtcgattttaaatctcatcaatcactagcaagaccagtcaaatatcaagttgagatgaaaaatggtaaattaaattatgaatttgtaattcctaagacagtaccagtgggtacatatagtattcatgttacttgtgagggattagatctttatagtgatgagtatcgtatttcgttagatcaagatataaatattgaaaactgttctaaatatttagatatttctttggttaatgatcaagcctataaaattacaagtataactgatggtgacataaaaagcggttggagtaataatgggaatacgtctttattgtttgaagttaaacctgaaaataataagtttgccaatattgcattaaagaaaatgagaatttatacgagtaataaaaacattgaaactgttaccttaaaaggtattgcgaatactaattattatcgtaatgttaatgtcaatgaaaatgggatgatcaatgatttagctggtgattttaaaccagactggaaaagtgataaaaatggggattattttgaagttgatcccggttatttatctttgggaaatatatttattttagaattacaaagtaatgaaaatattgtaatcaatgaaattgaaacagaaggtgtatatttaaaagataatcttttatcaaatgcccgagtttatcataatggtgaaaatattgatgcagctggaatggttgataataatgtaagtagttattataaaactacatattctgatagtgatgagtatatcttagatttttccccacggacaattacaactaatgaacttgtttatacagcacattttcctaattcacaaggtattggtaatttgactgtggaaatttgggatggtaatagttggaaaaatgttgatacatttgattttaaacataaaaccgataatcaaattagagaatcacagcagcttatttttaatgaacttacaactagtaaaattcgcttgatcgtaaataaagctaatctagtttgggataattcctatttatttacagatttaaatgcaattggaacaataaataataatgctcagtactatgctgaaagtattgataccaatatagttgtaaatcaaggtgaaagcaaatttccaattcctcatttaaaaggctatgaggtatcgatcaatagttctgatcatgaggaaatcattgatttaaatggtaatattaatgcacctttgatagatacaaaagttaaaataacattaaaggttagtagtgaagatggtcaggatgttggtatcacagatgagtttgaagttgttgtaccaagaagagttttgcccggcaataaattgatttcaactattgttgataatgaaacgatttataataatccgtcaatgggatgggttcaatattatgaattccaagataccgatgttgataaatattgggctgaaatggatgaattatatgctcaaggtttaaagacaaatattttatatattcgtaatccttggagctggtatgaaccatcagaaggaaattatgcatggaatgatcctgatagcaggttgagtaaattaattagtggagcaagagcgcgaggtattcaattagcttttagggtattggtggattcaagtgatgcttttcagcaggcaacaccagaatatgtatttaaagcaggagcaagctggtataaaactgatcgaactgatgatacggcaccagaaatcgatgctaaagatccatatattaatgatcctgttttcttagaaaaattagataagtttattaaagcatttggtgcagagtttaataatgatttagatattgcttttattgatggtatgggctttggtaactggggtgaagcacatcacgttaaatttagtactgagtgggatgataatgtttatgatgcggttgaaaaagtgattaaaatatatgataaatatttcccggatgttttattgggagctcaagaaggacaaccagaaaattatgggactcaagaaaatgatgagatcattaatactgacaaaccttatactggagcatttgacaaagaatatgattttgttgttcgccgtgatacatttggctggatgacggatgcaattagaaatcaaacattagaatggtttaatcaaggaataccagtttttgcagaaaattgttatcattcatttaaagtacgagaatactggtataataatgctggttatccgactttggatggtattttacgtcaggtcgtagctgatgctttgacatgtcgagcaaatactctagatgctcgggttgtaatggactgtcagaaatggctagagaatgatcaacaaaacggttctggtttattgaataaatttggtttgaatggtggctatcgcctcgctttgactagtttagaagttcctgagcttttcacgactggggaagaaataacgattaaacaagcgtggcgtaatttagggctaggcatgttgccgaataaaaataaacattgggataataaatatcatgttgctttcgcattattggacccaaaaacaaatcaggttatttatcaatataatgaagatactgataaagtaaacccgggtgattggcttttcgaagatggaaataatcattatgagactacatttaaattgccaaatagtattaaatcaggtgaatacaaactagcaacagcaattgttaatgataaaaataataatcttccggaaattgctttagcccttaaagatgcggaagtgacagagcagggctggtatgttttagatagtattaatgtaaaaaatataaatgattcagatacaacatttggtatttttattgaagatactgtaaatggtaaagttatagctgataggtcaactgttaacgctggtgaaagcgttactttaaaagttgttcctgaccaaggctatgaacttgatcaattactaatcaatgaaaaggcagttgaaattaaggataactcatatatgattaaaaatgttacggctgatattcgtgtaagggcctcatttaaaaaagctggtgaagtaaccgtaaaacctgatgagtctaaggatagttcagtagtagcaacgggagatgaggttcaattatttggatatataggaatgtttatcggagcattagttttattagctgagttgaaaaggaaatttaaacatcagagctaaaatataaaagcaggtaatttacctgctttttccacatataattatatttactaaaataataatcttttattagtaaattaattgacatggtttacgtgattaactataattgttagtgcataggattgttactatttgattaggcaagacctggttgtttaaagcgtttataagcgtgatgaacaatcaggtcttttatatttatttgggaactttaactaatcaaaatagctattctatacgggaaaaggaggaagttatgaaaggaagctggaatcaaaaattatgtgctgtagcaactgtttcaatgttgttatcatcagcaccagttggggtattagcacaagaaaatgcaagaattactcagtcagaccccgaagaagtatatgttgatatcattggagatgggcaaagaaccacgctatttaatgaaaattggaagtttcatcgtggtgatataaatgatgctcaaaacaaagattacaatgattcaacttgggaaacggtgaatttgccacatgactatagtattgatcaagatttcacaacaagcggagaagcagagagtggttttttaccaggtggcgttggctggtatcgaaaaacttttgtagtacctaaaaaatatcaagaaaaacaattgatgattgagtttgatggcgcttatatgaatgctgaagtttatttaaatgggacaaaattaggtgagcatccatatggatatactgcttttgcatttgatttgactgagggcttaatctgcgatggtgagactgaaaatgttttagtagtaaaaactaataataaaattccaagtagtcgctggtactctggaagtgggatttatcgagatgtaaagttaacagttacagataaggttcatgttggttataatggaactaaaatcattgctaaagatttagaaaatactaaggacaataatgttaaagttgatgttacagcaacaatcgacaatgatagcgatacaaataaaacgatcacagttaaaaatactttattggatgctcaaggaaatgccgcgggtagtaccgtcactaatgaagttgaattagcagctaaaagtacaaaagatgtaaaacaggaagtgtctgttattgctcctaaattgtggtccactgaggatacaaatttatatacaatgaaaactgaaatcgtggcggataataaagttttagatacttatgaaactgagtatggtttccgctattttgattttgataataatacaggtttttcattaaatggtgaaaaaataaaattaaaaggtgtttgtctgcaccatgatcagggtgcactaggagcagttgctaatcgtgatgcaattgaacggcaggtcaaaatattaaaagaaatgggatgcaatgcgattcgtgttacccataatcctgcggcatcagttttattagaagtatgtaatgaaaatggaatgttagttattaatgaagcatttgatggctggaccgaatataaaaatggaaatgttaatgactacacttcacattttaatgaagtaattagtaccgataatcaaattgttaatggaaaagctggaatgaagtggggcgaatttgatgttaaagcaatggttgatggtgctaaaaatgatccaagtgtaattatgtggtcattaggtaatgaaattgatgaaggagtatcaggaaatacctcacattatttaaatttagttgatgatttaattaaatgggttcaagaggttgatacaactcgtccagtcacaaatggtgataatcgcaaaaatactaatccaaatgcgatgctcagccaaattaatcaaaaaatatatgaagctggtggcgtggttggaatgaactatgcaaatggtgatcaaactatagctatgcacaatacttatagcgattggccactatacggttctgaaacggcaagtgctgtccatagtcgtggagtttataatactacgggtaaagatgataatactttacaaatgtcagaatatgataatgatgaggcaaaagttggctggggacattcagcaagtgatgcctggcaatttgttattaagaatgatttcaatgctggagagtttgtgtggactggttttgattatattggtgaaccaacgccatggaatggaactggagcaggaagtgcaagtggtcagggagctaaacctaaatcatcatattttggaattgttgatactgcgggatttgtaaaagatacttattatttatataaaagtatgtgggacgaagatacaactactttgcatttaatgtcaacatggaacaatgatgaaatagtcaaaaataataatggtaaggtcaaggtcgatgtatttactaatgctgcaaaagtggagttatatttaaatgggaataaagtgggggaggatacagcaacaacgcatactactgctttaggatataagtatcaaacattttcaaatggagaattttacccaagctttaatgtaacctgggcttcaggaacgttgagtgctaaagcatatgacaaaaaaggtaatttaattacagaaactgaaggaagaagcagtgtaacgactaataccaaagctgcaaaattagcgataagtgctgataaaaaggaaattttagctgatggcagtagtttatcttatcttactgtcgatgttaaagatatgaatggaaatattgtcgctggagctgataatcgtattaatttcaagattgaaggaaatggtaaaattgttggggttgataatggtaatgcagctgatactgatagttataagggaacttcacgaaaagccttttcaggaaaggcattagtgattgttcaatctactaaagatgagggatcatttacacttagtgccagcagtgatggtttaagtggttcaaatatttctgtcaagacggttaaaaatgctgttgagggtgatgcttatctgcaaagttacacaattgctaaaaatttatatgttaatgttggtgaagaacctgatctgcctgcaaaagttgtaggaacatacaataatggggagacaagagacttaacgattaaatggaatgaatatgataaagaatcattaaataaaattggtgagttcacaataacaggaaaacttcaggatagtgaagctgtagtaactgtaacggttcatgtaattggtaatgtcgtagccatggaaaactattcaacagtaactagtgcaggaattacaccggtattaccacaaacggttcgaggactttatgaaaatggaaattatagtgaggcttttccggttaaatggaatattcctgctgatgcttttaaaaatgaaggaatggtaacagtaaaaggtacagtcaatgttctaaatgaagtaaaagatgttacagcaactgttcgagtagcaccaaaattagctgattcacagaatattgcttcaaagaattatcaagatacaccattatttacaaatgggaaaatggtcaatggtgttccaagtgaaccaacagcaacgccaatcaatgattcattgagtgaattaaatgatgggattactaatgaaagtggacgcgaaagcgcacggtggacaaattggagtttaagaaatgaaaatcctccggtggatacttatgtacaattagaatggcaaaaagaatacttgatgcaaaatattaaactgtggcattttacggataatcaattcagtgttttaccaggtgataacaatgtccggtttgaatattatgatgttccaacaaattcatggcaagaaattgagtcttcgcacattacacaagtaccatatacatctggtgatactccatatggatttattcacccgattacaactaataaattacgcatatggatgaagtcaccgcaagttaataaatgtattggtttaacagaaatagaagtatatgattatattttaccagtaactgcaaattcatctgcaaatctagatgatttaaaattagatggggttaatattaaagaatttaatggttatcgagggtatgataagcttactaaaacatatactgttgatttgaaaacagctgataccccatcagttatagctcaaggtaataataatgaagcaattactgttttaccagtatataataatgaagtaaagatcattgttagagcggaagatggtaaaacgatagaaaattatactattaaatatattatctcggtaaacaaagagtttcttgaaaactatattgaaagcgatgaaataaagaaagtttttgaaacaagtgaagaatatacagtccaatcgtatcaagaatttaaggaagcatatgatcaagcaatagtgattttgaaagatgatcaggcaacacaaaaacaagttgatgatagttatgaaaaattacaaactatgtatcaagctttagttaaaaagactgaagaaaaagttgataagagtcagttagaagcacttttagctattgctgataagattactgaagatattttaagtaatcttgatgctgatttagttaaagagtttaagaccgctttacaagcagcacaagatatttatactggaaatgatgtaactcaagctcaggtaaatgctgctattacacggttaaatgtggcaattgaaaatttaaatattcgtgatttcaataagattaaattacaggagctagttgagcggactgaaaaattatctgctaaagattatacaagggcttcttgggaacgattagaaaaagctttatcagcagccaaaattgtcttagcagatgaaaaggcgacactggcagctgttgatgaagccaaaacggttttacaaaatgctctagaacaattagagaaagttgcgattagcgaagagtcttctcaaggagtaaaaactggtgatgcggctaattttgctggtatatttgcattaatggtttcaactgcgagtctggttttatggatgaaaagaagaaaagaaaataattagtaataatagaaggatgttttaatatgacatccttttttggaaatttgacatttttatgattatcgtattcgttgtatattcttactaagattgtataatataagtatagaaaaaggaggcgtttaaaaatgagtataccaataattattgtacttatagtagtggcgttaattgtgatttactgcatagttgcatataacacattaactaaattaaagaaccgggttaaaactaactgggcacaaattgatgtggtattaaaaaggcgggctgatttgatcccgaaccttgttgaaacagtcaaggggtatgctagtcacgaaaaggaaacgttagaaaatgcaataaaagcaagaaatacttatgtgactgccaatagtcctcaagatcagcttgcagcttctggtgaattaaatcaggctttaagccgattaatgatgttaggtgaagcttatccggatttaaaagctaatactaattttatggaattacaaaaagaattgacagctacagaagataaaattacgtatgcacgacaattttataatgattcagtaaataaatataccaatcaaacagaagttttcccttcagtgcttattgcaaaaatatttggttttggaacttttgattattttgaggttcaagaagcagataaagaagtaccaaaggttaaattttaaaatgaaacttaaaaaattatttttagcactctcaatctttctggtttctttgatgccgttacctgttttggcatcagggaatgaccttcaagcggttaatatgaacatttatattaatcaagatggttcagcaaaagttgaggaaacttggaagatggatgcgattgaaggaacagaaaactacaaggcatttaataatctttatggggctacgatcagtgatttttctgttgtcgatgaaaaaggaacaaaatatcaatatgttgataattgggatattgatgctagtcgtcaagagaagaaaaataaatgtgggatcattgaaaagagtgatggttatgagttatgttatgggataggtgattatggtcaacacacatatacgatgacttatacgattactccatttgttaatcaatatagtgatgctcaggggtttaattggcaattacttaatcaggaaatgaatcctaaaccagctgaatttgaagcaacgattagttctgattacaagttttatgatcaagatagtgatatttggggctttggctatgaaggacaagttatttttgatgatcatggggcgataattatatcgaatcgtgatttaaacaataatcgtcgaggcgatattaattatgtcaatattttagttagagtacccgatggaacttttagcaatgtaataaccaaaaatgaatcatttgaagctgttttagaagatgcacgtgatggctcaagttatcaagaagattctagtgatggttcaatatttatgtttattggtattagtgttgcggtacttgctgggataattgcagtaattgttggagttgtatctaaagcaaacaaaaataaacaattatattttagtgacggtaacaatgaaattccgacaatggaacatgttaatccgttccgtgatattccttgtcataaagatatctactatttttattacgttgcaacaaaagcagggattatccagcaagatgatcgttcaggtatcttgtgtgctatgttgttaaaatggatcagagatggctatgtgaattttaccatggaaccgggcactggctggtttaaaaaagataaatatgaaattgatttcagtggtgagattccaacagaaaatattttagaagataagatgttaggttattttcgggaagcaagtggtgataatcaaatcttagagaataaagaatttgaacgttggtgtaaacggaattatgaagaaatcgaagattggtttaatgatttgattgaatttgaagaaaaagaattaaaagaaaaaggcttaatgaaaaagcaaacaacttataaaaagttcttaggaatagatattgcaaatgaaaaagtagtttatgaaccatcatttagagatgatatcatttatactaaaggattaaaacgctttttattagactttagtagtattgaagaaaaagaagtaattgaagtaaaactctgggaagaatatttaatgtttgcttcaattcttggtattgctgacgaggtagaaaaacaaattggtaaactctgcccagaatttaatcaatattcaaatattgattacacttatacgatgttagcaacgagaacatttatgtacggtggtgttcgtagtgcagctaatgcatatagtgcagctcatagttcatcgtatagcggtggcggtggttttagttcctttggcggaggcggaggtggtttctccggaggcggcggaggcggaagccgataaaataaagaaaacctggaagaatgaaatgaatctcctaagttgttgcttcaacttaggaggttcgcttcaaaactccaggttattttattgttgtgcttctaattcagcgattttatcagcaaattgaggtaagtgttttttatgagcaatcaacatttcatctaataatgttttagcaatttgaccacttggaactaatggattaattgtaaatgcatgtaatgctttaccataatcaccagtaacggcagcttcaattgtagtttcttccattgctttcataatttgaaccattccccgagctgcaggttttaatgttccccaagaaattggcattggtcctgctgctgtaatgatagcagatacttcagctacactatcatatggaagatcagttaatgcccctttgttttgtgttgatacgaccatagttgtacgtttatcattatagattgagttgattaattcacaagcagcatcactataataagtaccaccacgttttgtcaattgttctggtttataatctaaattaggatctttatataattcaaataattcagcttctgttctttttacaacttcagcacgagtaccattttctttgaagtcggcaatttcatcttcaagcatatcatcagtgatatagtagtaacggtgatacatacatggcagatatcctaaatcttggatttgttctgcaacaaatgaaatatttttaatatttgctactccggcatcagcggcacgtttagcggctttttcctcttcttcctttgcacgtgtagcattagccccaaattttcttaaaccatcgttttcaacatatagtttttgaattgctttatcagttaattcagttccatcaacatcccatactcgatgccagtgaaaatggtttaatccagcgaatttaaagaataattcttcttcgtttttatctaaagctttcccaaccattttacggcaagagataggtacattacataaaccaacaactttatcccatttaccatatttgataacagcttcagtaaccattccactaggattagtaaagtttactagccaggcatttggacatagtcttttcatatcttcaacgatttctaagataacaggaacagttctaaatgctttaaacattcctccggcaccatttgtttcttgcccaataatcccatgacttaagggaattctttcgtctttaattcttgcatccaataagccaactctaaattgagtagtaacgaaatcagcgtcttttaaagcttcttcacgatctaatgttaaatgaatcgtcataggaacacccgcagcttttaccattctttgtgccattgctccaacgatttctaatttttctttaccttcttcaatatcaactaaccacagttctttgataggtagttcatcatatcttttaataaatccttcaactaattctggagtatatgaactcccgccaccgatggtagcaatttttacaggtctttttgccatttgtaaatctcctttgttttttgttacaaggctattataacggcaaaagaaaagaaagtggtcttttttcaggtgatgaaaaccgctttcattttatgaaaataatataataagttatcgtgcttatggtaataattaatatattattttaataacaggttgtatggattgatagttccgggaattacttgtaaataatcattttttaataattcattgattacattgcataatatattaatatcggtttcttcaccagtacattcaagatagagactttgactgccacaagcatcacgtaatttgagaatgtagtcaaattggcgttcttttaataaattattgatgtcttggacttggaaaattgaaattgttttcatgtttttaactccttttgttaaaataatgttataatttcattatataaaagtcaaggaggatatataatggctgcaactgaaaaagaaaaagcaaccaagctggctcatgagttagtcgcatacatagagagtgaacaaagtgatttgaaggctagtgataatgaatttgatgctttatggcaaagcatttatgatgtttgtatgctagttcactttaacattttagatgaactcttgagtgaagaggaatatttagaaggagttacttggctaaaagactatcaacatctcactaaagattaccaagataaagaattggaattatgaaaggataaagaataatgaaaaattatttagttgttaccgatacaacaagtgcgatgaacggggttcaagcgaaagaatctggaattgagttagtctcactaagtgtactgattgacgggatcgagtacaaagaccaaattgatatttcaacggaagaattatataaaaaactggaagctggatgtatccctacgacatcacagccaaatactggatatttacatgaattaatggcgaattggaaagctaaaaattatgaagctattatcattatcacctgcagtagtgatttaagtggaacttggagtggatttaatcttgtgaaaaatcagttagaaatgaataatatgtatatttatgatagccgccaagttggtgcacctgtcatggatatggcattagcggctaaacagatggctgataatgatcatgatgtaaatgaaatttttgaaatgttagaaatgaaaactaaaaatagtttttcttttttagccccatttgattttaagcaattggcgcgctcgggacggttatcgccggtagctgctaaaatggcatcaatcttgaaagtaaaagctttactttatttgaaggaagatggtagttgtgtcgataaatatgcgatgagtaggacagaatcaaaaattgttaaaactgtaattgacaaatttaaaaatgctggtgttaatgctaaggattatacattatacatctctcatgctgataatgaagaatcagcgctgaaagcaaaacgattattacaagatatttttgataatattgaggttatcgtaaacaagttaccagctgtattgacttgtcatggcgggatgaaatgtatatctgtgcattatatacataagatgtaataggtgagaaaatgaaagttgttgatatgcattgtgataccatcttgcggctttatgatgaaggtggctgtttatcaaaaaatgattttaatattgatttaaagaaaatggttaaaggtgattatttgttgcaaaactttgcgatgtttgtaaacttaagtgatcatcttgatccactaacaaaggcacagcgattaattgatctatattatacagaactagaaaaaagtcctgagctgattaaaccagtatatagttatgaagatattcttaataatcaaaaaaatggtctaatgtcagcgatgcttacattggaagaaggggcagtcgtaaataatgatcttgcaatcttacgtaattattatcgtctaggcgttaggatgattactttaacttggaatcatcctaacggaataggttatcctaatttgattagtactaaggaatttaaagatttatatcatttaaatacagaagatggattaactgattttgggattgcttatgtcaaggaaatggagcggttgggaatcattatcgatgtttcacatttgagtgatgcgggattttatgatgtattaaaatatacgacaaaaccgtttgttgcatcacatagtaatgctcgtagcgtttgcggagttgctcgaaatatgtctgatgatatgatcaaacagttagcgaaacgtaatggcgtcatgggaattaatttttgcggagatttcttaaaaccatcgagtcatggcgggatgcgttcatgtattgaagatatggttaaacatattttatatattaaggaactggtggggatagattatgttggcttaggtagtgattttgatggtattgatcaaaaccttgaattagctgatgcttcgatgatgccccaattagctgctgcactgcaggaagctggctttagtgaaattgaaattgagaaagttttttataagaacgttttacgtgtttatagtcaaattttatagaaacagaaaaacgacaagtggggaaatcacttgtcgcttttattattagttatcagggaaaggatactaataatacatgatatcagggaaggatatctttatatattgtttgtagtcattatattgaagggaaaatcgaatatttcttttgactacattgttagtatataactaaacaatggtgaaaatgtatatagaatatcttaaaatatgtgataattattcgttcggatagatatcgagctattttaaaatggcgaaatatagtgtataatacacataagtggaggaatgaggatgaaaagcttattttatcgtttaattatctttttagatacagctagtgaagctgatacaaattataatattgcctggtatatggctcataatttttcgaaagtggccaaaatgggaattagtcagcttgctaaagaatgttatgtatccccggcaacgatttcacgtttttgtcgtgctttaggatatgaaaattatgctcatttaaaacaagaatgttcttcatttgcttcagatagcaaaaagtttaataatttaattaatgttcctttggacatgatgaaagataaacctcaagaatgtactaaatattatagtgatcaagtatgtgatgctatttcaaaattgtcacagcggttagactggaatgtgattgataaagttctacaggctattcatgatagtgattcagtagctttttttggaactcagttttctcattctgcagcgttgcattttcaaactgatttactaatgctggaaaagtttacaatggcatatatggaaacagaacgtcagattgattgtgcgcgtttgatggatgaaaatagtgttgcaattattgtgacagtaaatggattttatgcacggagtaattcgaaagttttacagtatttaaagaaatcaaaatgtaaggttgttttaatgacaaataatccagggatagatattggaataaacgttaattatacgattgtattaggtgatagcgaacagcgaaagattggtaaacatacgttattaacagcagttgaattgatgtcactgcgatattattctttatattatccaggaattcaggaaaaaattatctaaaaaggttttaacctttttttatggaaggaaaaagttatgcgtgagattaaatgtgaagatattacaaaaacagtaaaacaactatgtatggaagcagcttgtaatttacccagtgatgtgtttaaggcacttaaagataagacagatacagaaccatatcccttagctaaaaagactttggaagtattgattgataatgctgatttagctaaagataatatgatgccgatttgtcaagatactggtatggcttttgtgtatattacaattggacaagaagttcatgtggatggtgatttaaaagctgctattaatgaaggagtgcgtcaagggtacgaggaaggttatcttcgtaaatcagtagttgatgatccattatttgaacggatcaatactaaagataataccccagcaattatttattttgatcttgtttgtggtgatgaatttaaaattgttgtagctccaaaaggatttgggtctgaaaacatgtcacaaattaaaatgttaaaaccaagtgatggattgcagggagttaaagattttgtaatgaaagtggttaatgacgctggacctaatgcttgcccgccgatggtgattggtgtagggatcggagggtcatttgacaaagttacgatgttgtcaaaacaagcaatgatgcgtgaaattggaacccatcacgaagatagccgatatgctgctttagaaactgaattattagagatgatcaatgctacaggaattggaccagctggttatggtggaaaaactacggctctatcattgaatattgagactcatcctactcatattgctggaatgcctgttgcagtaagtatttgctgccatgtagcgcgtcataaggaggcttcattatgattaaattgacaacaccgcttaccgttgaaaaaataaaacaattacatgctggtgatgaagtgttactaagcggaactatctatacgggtcgtgatgcggctcataaacgtttgatggctttgattgaagaaggaaaggaattaccttttcatttagaggatcaagtaattttttatgtgggaccaacgccaagtaaacctggtaaagtatttgggagtggaggacctacaacgtctgggagaatggatgcttttgcaccaacaatgatcaagttaggattacgttcgatgattggtaagggatatcgtcagcaggcagttaaagatgcaatcattaaatatcatggagtgtattttggtgctatcggtggagccggagcgatgatgtctaattgcattaaagaatgtacagtaattgcttttgatgatcttggacctgaagcgattcgacgtttagaagttgaggatatgccattagtagtagtgattgatagtaatggtaacgatcaatatgaattagggcgtaacgattatttaagtacatgtaaataaagagaaagtattaaagaggtaatataataatgtttaaaaagaaaagagattatggatattacagcagttatggaacaagtagtcgaagtcgccttaaggttggacgcgttgctcttgttggggctgttggggttgtcttagttattggaattgttgttgtgttaaatttgacacggattaaattattaatcaagggctattcattttcacaagcaagtgaaattttgtcattaacaaaagaacaagaaaatgaaattttatcccatgataaacttgatcatattactaattggatagcaaattctaaaaaagtttctttatatgatgaatacgaaaaatatctaggcatgaataaaaagatggaatatgctgatgttgttacatatattaatggattatttaaagaagaagtacctaaactaaaaagtatggggtatagtgagaaagttatttggaatttgattagtgataaagtatcaaaagaagatttacaatatttgatcgatcataattatactgccaaggatttagagccttatcgcaaagtaaaaggttatcaaattcaaaatcttgaagcgtatatcaacgcttataataattacaaagactataattatgcagtatgtattactaactatccatttttgatttcatctaatggtgagcctaaagaaagctatacaattactaatcctgatgatttattagttttagtaaaaaaaggtttctatttaccagaaagctatgaacctaaattagtagatccggaaattccagtagctccagattgtcaaaatccgaaaatgactaaagaaacatcagatgctttaactaaaatgtatgaagcagctaaaaaagaagggttagaattagttgttaatagtgcgtatcgttcatatcagacacaagttgatacaatggctgattttgaaagacgttttggcgggcagtatgcaaatgaatatgtcgctcagcctggagcaagtgaacatcaaactggtttaggaattgatttaactagtcaaagtgttgtagaaggtaaaaaaatcacttttggtgatactgatgaatataaatgggtaattaaaaattgtgctaaatatggctttattatccgttttgaaaatggtactgacggaataacgggaattgctcatgagccttggcatttacgttatgttggtaaagatgtagcaaaaaaaatcgttgaaaaggaatggacttttgaagaatattgtttatataacaatgtaatgccaaaagttacgaaaaaataatctaggggttacctctagattattttaatgaggtaaagaaatgaaaacattaattactactttaaattcaaaatatatacataagtctttatcgttaagattgctttatgtagctactaaagaatatcatgaggtggattttaaagaatatacgatcaaagaggatcttgatacaattgcaaatgatattattgaacaaaaagtacaggttgtggcttttagtgtctatatttggaatgttgatttaataaaaatattgatagataaattaaaaaaaatggacccacaattagttattgtaattggaggaccggaagtaagttatgaaattgattattttctagataactttaaaattgactatttaattagtggtgaaggtgaggtggcttttaaagaactgttagattgtttagaaacacagcagccgattaatattcaaggaattagcagaaaagataagcgagattatcaacaaactaagccggttgatctacaatatcttgaaacacttgaatcaccttatttattaaaacgtgatcttgctgatatggataagcggattctttattttgaaacaagtcgcggctgtccatatcaatgccagtactgtttatcttcattagaaaaaggattacgcttctttagtttagattatttaaaagcgcaattatcattattgcttgatagtggagttaagacaattaagctgctagatcggagctttaatgctaaaacagctcatgctttggcgattttagaatttatttttaagcattatcgaccaggaattcaatttcaattcgaaattaatggtgatgtactagatcagcgaattattgattatattaatgattatgctccaagaggattattacgatttgaaataggaattcagtcaacatatgagccgacaaatgaaatcgttaaaagatatcaaaattttgaacggttaagtgaggtaattaaacagttacagcaaaatcataaaattgattttcatttagatttgattgcaggtttgcctttagaaaacctagagagatttgcccgatcatttgatgatgtttttgctttttatccaaaggaactgcaattaggttttttaaagttattgagaggaacaagtcttcgaaaagaggcagaaaaatatgggtatgtatatgatgaaaatccaccctatgaattgctttatagtaatgatttaagccctgaagatattgggaaaattcatttggcagaagaaatgttagagaaattctggaatagtggcaagatgccaataacaatgaatacagtgataagaacagtcgcttcacctttttattttttcttagacctgggcaattattatttgaaacaacaatttaaaatgtttaaatttcaaaatgatgaattatttagttatttagacgaatatttaaatcggcagtatcaggatttattgattgaagactatttacggttatcaaaaataaaacctaaacgctggtggaaggcccgtttagataaaagcgaagcacgtgaaacaatgcattatttgatagaaaaatatgacttagaccaagaagaagtctttagatatggggtggttgaaaaggtaactgatggctacttattagcgatttatcaaaattatcaggttagtgtgaaaaagtattcttgataatgataaacggttatattatgttagataacgttttcctgtaatgggagagcgttttattttatgattataaaaagggctgggtaaaggagtatataacatgaattaaaaatacaaataagatatacttaatagtgcatggagggatatagaatgatagaaaatattcgtaagagagatgggcgcctagtcgcatttgagttagataagattgcaggagctatatacaaagcatttgaagcaagtggtggtaaatatgaattaaaaaatgccatgaatattgctaaaacagttgaaacaaagctagaaaaaaagaagagtgaattaccaacggtagaattagttcaagatacggttgaagaagtgttgattgaacaaggatatgtacgagtggctaaagcctatattttatatcgcgctaatcgtacgcgtgaaagggatatgaagtcacggctaatgaagacttttgaagagattacttttgctgatagtaaagatagtgatctaaaaagagaaaatgctaacgtgaatgcagatgctccgatggggacaatgctgaaatatggagctgaagcagcaaaacagtttaatgagatgtttgtattaaatcctaaacatgcacgtgctcatattaatggggatatacatattcatgatatggattttttaactttaaccacaacttgttgtcaaattgatttaattaaattatttgcaggaggattttcaactggccatggagttttaagagagccaaatagcattagtatctatgctgctctagcttgcattgctatccagtcaaaccaaaatgatcaacatggaggtcaggcaattcctaattttgattatagtatggcaccaggtgttgcaaaatcatacttaaagcatttttatcataatttagctaaagcaattactttattagtaaaattagatggtgaagatattgcgactaaagtaaagggagaaatgcgtttaaaacctactttagataaaaatgaggcatttgaagaacaattaaaagaaacactgaaagctaataaagtagataaatttgtagatgaaatcgttgaatttgcaattacaagcgcttatgaagaaactgatcgagagacatatcaagcgatggaggcgtttattcacaatcttaatactatgcattcaagagctggagcacaagtaccgtttagttcaatcaattatggtatggatacttcaagtgaagggcgcatggtaatgcgtaatatattattagcaacagaagctgggctaggtcatggtgaaacaccaatttttccaattcaaatatttagagtaaaagaaggaatcaactataatgaaggtgagcctaattacgatctttttaaattagcttgtcgtacctctgcaaaacgtttattccctaatttttcatttgttgatgctcctttcaataaacaatattataaaggaacgccagaaactgaaattgcttatatgggatgtcgaacacgagttatgggaaatgtttatgctccggacaaagaaattagttttgggcgtggaaatttaagttttacttctatcaatttaccaagattggcaattcgttctaaaggagatgtaaatgagttttttgataagcttgatggaatgttagatttatgtattgagcaattgttagaacgttttgaaattcaatgtcgtcgtaaggctaaaaactatccttttttaatggagcagggagtttggcttgatagtgatgaattaaaacctgatgatgaagttcgtgaggttttaaaacatggaactttaacagtcggatttatcggattagcggaaacattaaaagctttgattggggtacatcatggtgaaagtgaaaaagctcagatcttaggattacaaattgttgctcatatgcgcaaggcaatggataaagcaactgaaaaatataatttgaattttagtttgattgctactccggcagaaggactttcaggtcgttttgttaaaatggataaaaaactttttggagaattagacgggattactgatcgtgaatattatactaatagtttccatattcctgtatattatccaattagtgcttttaagaaaataaaattagaaggaccatatcatgaattaactaatggtggtcatattagttatgtcgagatggatggggatccgactaaaaatattgctgcattcgaaaaaattgttagagcaatgcatgataatggaattggttatggagcaatcaatcatccagttgatcgtgatccagtatgtggttataatggaattattgatgatgtttgcccgttatgtggaagaagcgaggaagaacatcatggttttgaacgaatccggcgaatcactggttatttagtaggaacattagatcgttttaatgatgggaaaaaggctgaagaaagtgatcgtgtaaaacacgaaaccaaggaatgaataattaatggaaattagattatttggtacggttaatgattctattgttgatgggccgggcttaagatatgcgatttttacccaaggttgttttcataattgtttaggctgccacaatcctaaaagccatgatattaatggcgggtatattagagatactagtgaaataattaatgaaattgatgaaaatcctttattagatggaatcacgttatcaggtggtgaaccaatgttacaaatcgagcctttaaaagaactttgtaaagctgctcgacttagaaaactaaatattgttatttatagtggttttacattcgaacaaattatggatgatcctaataaaaaagcattattggaactttgtgatatgctaatcgatggcaaatttgaattagataaaaaaagtttagctttactttatcgtggttcatctaatcaaagattgattaatattcaacaatctctaagccaaggagaggtagttgaatatttggctgatgagaataatgaaattaagatttaaggaagcacagcttccttttttgttttaaagattggtgattagtttataaagcaaataaaaaggcactatgcaagtgtgcctttagactatacttatttaattaataagttagcttgtaaccaagctctctcttcatttgttaaaaatggtgcaacatgatcaaatactaattgttgataatcattgatttgtttgatttcatgattagataataattcaagatctaaaccatctaaatcaaatggaaccattgtaattggttcaaattttaagaactgaccatattcattagtttcgacttcaacacataacaattcattttcatgacgaacaccatgactattttcgatataaataccaggttcatctgttgtgatcattcctggttcaaaagcacacattttagcaaatcctggacgatcatggggtctgaatccatttggtccttcatggacgtttaagaagtgaccgacaccatgtcctgttccgcagcgataatcaagattgtattcataaactataccacgtgctaataaatctaggtttggaccagttgttcccgctaagaaatgagctgcttgtagtctaaacattgcttttaaagccacggtaaaatcacgtctttcaatatcactgataggacctaaaacaaaggttcttgttgtatcgatcgttccatctaaatattgaccaccagaatcgattaatagcattccctcattagttacttttgcacaatttccaggttctgctttgtagtgcatcaaagcagcgttagctttgtatccgcaaatagtatcaaaacttagatcaaaaaattcattttgttcttttctaaatgctgctaatttatcagagatggtaacttcatctaattcgatttttccaacgttgttttttaaccaatacatgaatttagtcatagcgacaccatccttgatatgggcatttttggttgctttgatttcagtttcattttttatcgctttaaaatgttgagttggattaggtgctgtttttatttcacaatttagattattgaagatttgataattaacaatttgatcatctaataagacttttccagttagttttttaacatcttcataaatatcattataagctctgatgataatactatccctttttaaaatagcttcagttttaacatcaacgacgttatcttgaacatatagaatagcattatcttgattaatcaaagcataagatagtacgacgggattacaatctacatcgttaccacgaatgttaaataaccagacaatatcatctaagctagtaataatatggtgttggcaatctcccatggcactgcgcaaacgtgcaagttttgaagcacgtgattcaccgcaatattcttcatcataaataaaagctggctcatgagagatgctagggcgttcactccaaacttcatcaactaagtcaacatctgtaattagtttattacttaaacgagcaacttcttgatatgacattactcgtccatcaaaaccaacagtcttatcagtgttttgatcaagatattctttgattgttggaaccccaggcatagccattttcattaaaataatgccacttccagctaattgttgttctgcttggataaaataacgcccgtcagtccataaacgtgcttcatctagactgattactaatgttccagcagaaccggtaaatcctgataagaatttacgtcctctaaaatattcaccaacatattcactttgatgaaaatcactagttggaatgatataaatatcaattccattttctttcattaatgtttgcatttttgcaatattttcttttatcatattcataacctcactaacaatactttatcacaactgattagctccctcaatgaatataaaaaaaataaaaaaaaaacttacacaaataaattttttatgctaggatagcattgcattaaaagaatattactaaataatggtagtgatgattaagtcagctgacaaagattgtagcgaaagttatggttttgttaactggcttttttatgttaaaaggaggaaaaattaatgccaacaaatagaaaagaaagtttagtttttacaatgtttatgtgtgcctttatggttttttggatgagtgtctataatgtcagtttacacttcggcttttcaagcgaagcaatcaaagaagcatggttgggattcccattagcctatttatttgcgattttatgtgattgggtaataatatctaagtttgctaaaagtttagcttttaaagttgtaaatcctaaaagtaaaccacttattaagattattatgatctcattttttatggtctgtggcatggttattttaatgtctttatacggtgcagttgaacaggctggaatcagtgaacagactttaatggtgtggttgacaaatattccaaaaaattttattgcagctttaccactacaactgttaattgcaggaccttttattcgaagcgttttcaaaatcttgtttactagacaaatcgcatagattgtctagtgattttatcaaacttagcgctataattatcatgttaaaaaagcatgataattatttttcacgaaaaaaatataagtctttaaaaagtttgttaaatcgttgtaaacccttgtcagactagggatacagcgaaaatgactatttttttcaattgatagattattatcgttgcatttttaaaatataggagtatacttatctcaggcaaagggggcttatactatggatgatgtaattcaaaggttagtagaaatagaccgtaaatgtgtcgaacgtgttgaagctgcaaaagctaagaaattagatgcgcaaaccaacatgaatgaaaaaagaaaagagatatatgatggttttgtcaccgaacaaaacaaaaagattgaggcgcataaagctgaattaatgaataaaaacaaagaagaagcaaagcagcttgatcaagattataatgatactgtagctaatttagagaatctttataatcaaaataaggacaaatggatcaatcagattgtcgaaagatgtttaaagtaagaaggtgaaggtatggctttatcgtcaaatgcactatgtgctaaggctaaagcgatgtatggataccgcattggtgaggaaggttatagtgatctatgccggaaacagtcacttagtgagatggtaacatacttaaaatcgcaaacaaagtatagtggtgttttagaagatattaatgtccgtaacgttcaccgtcgccaagtagaggctgctttaaataaagaatactttgaacgttgtgcgagattaatgaagtatgcaccaaaaaagaatcaagatttctatagccaagaggtcattggaattgaggttcaattgattgttgataaggttgtcagtattaaagaaaaagatcaagcgagtttttctttggagatacctgattatttagcaagcaaaatgagtttcaatatttatggattgatcaatgttgataactataaggatctagtaacatatttaagagatactaggtattataaaatattagctgattttgattttacagcaccgattgatattaatgctttagaacgtcagatgaaatcactattttatagtacttatgtggctgccattaaaaagaattttaagggtaaagaacaaaaagaattattagatattttatcgacatcgattgagttgatcaatattacgaagatctatcgattcaaaaaatattttaaagaatcgaatgaaacaattaaaaattctttatatttagagcattgtcgaatgtcttcatcaatgttggatacattaattgaagctcgtagtgcaaaagaattgatggaattattagctaattctaaatataagctgtatttaggtgataaagactatgcttatatcgaatattatgttgaagaagttagatataatatcgctaaaagatatatgcgtttttctagtaacgcaccgttagtatatttaacatattcaatcttacaaaaggtagaggttgataatctaaaacatattattgagggaattagatatggacgagatgcatctagtattgaagagatgctgatctttgcataggagggattaatgaatggctattataaaaacacatttctttaatatttcctttgaacataaagatttgatgaaaatgctaattaagatgaccgagtatcaagatgaaatgtttcctcaagattctaaaaaaatagcaaataatgttaaaggggtatcagttatggatgaagctaatccgtataatgaaccactagataacatttatcacatcttaaatcgtttaaatcttgaaagtaatgttcaagataatgaatttaaagaaatcaacttgcataatgcaaataaattaatagatgatattaatgataaaattgataatattgtcaaaattaaagaagatattacaaaagaaaaagaagaaaatgatgaagcaatcattttgttgaaaaatctagaagaatcaaaaataagtgttgatgatgttaagaatactaaatatattacctgtcgatttggaaagattcctgtgaatgaatttacaaaaattcaatattatcgtgattatgaatttatttttagggaattgaatcgttctaaacaatatgtttggatcgtttatgctggacttacaagcagtatttctgaaattgataatgcattttcatcaatgtcatttgagccaattagcttaccggagtttgctcatggtaaagttcatgaagcaattgacgaattaactgaagagtcaacagctatggaacaatatattgctaaaatggattctaaactagaggatataaaaaaggaatataaagaagaggttttagaaacatttacaagattatataacttaaaaagactatttgataaatgtcgttatgttgtggacttttcacaaaaagcttcgatctacactttcagtagttttgatttaaaagaagctgaagcaaaatttgatgatattgatagtgtaaaagttatggaactaccagttaatatctatgaaaatagaaatattgtggcaccagtattagtaagaaataatagtttaatgcaaccgtttgaaaatgtcttgagtgtaacacttggtgacacttttgatccaacgacgatagttgctttattaacgatgcttatcggtgctgtttgtgttggtgatattggtgttggagctttattaattgtattagggttcttatttacaattaaaaaacctaataattttggtggtatgttaaaacgtttaggagctgctgttttaattggtggtttattttatggaacggcgttttatcgaattgaattgtaccagccgttagcaagtttaccattacatgttattcatactttcttatttggattcagtctttggatcattgcgatggtgattttaattattgtgaaaaaagttacgcgaaaatcaatcaagatatagaggagggatataatggcgatttcaagattaaacttagttagtattaattttgataagtatcgttacaatgaagttttattaaagctttttagccatgatgactttcatcctgagttggcctctaagtttattgatagtgtaacgggactaagtgtttacaatcaagataatctttatgaagaaatcttggtgcgattgaatgatgcatcaaataagtatcattttaagctagaagaagtgccagttgaaactaatcaaatcaatgtgctgcgggtaaaagaatatttagatgatctactgcttgatgttgagcgaattgatgctgtaaaagtacaattagatcggatgattattgaaaatcaggaagcaatcattcagttacaacatgttgctgatattgatgttgattttgatgatttgtttagctgtaaatatcttcaggttagatttggaaaaattccagtaaataatgtttctaaattagattattatgaatcattaccatttgtctttaaagcatttcacaatgataatcaatatacttggtgtatgtatattacaacgcctggtgatgcaccagaagttgataatattttctcatcattgtattttgaacggattcatattccggcctttgttcacggttcaccagaacttgctattggtgagattcaagaagaagctgatgttgctaaagaacaaagtgaaaaattaaaagagcgaattgataaaatgtttgctaatgaccgtgataagttgaatgaaatctatacgattgcaaaacatttaaatgatgtctttatcatgcaaaaatatgttgttgtaatcggtgataaactttctgtcaatggttttgttccaacacgtagtgttaaaaaattcaaagaagattttgaaacattagagaaagtaacagttgatattaaaccagctaatagtgatgttcgtttatcgccaccaacattgcttaaaaataattggttttcacggccgtttagaatgttcgtcgaaatgtatggggtacctaaatataatgatgccgatccaactttattagtggcattatcatataccttgttattcggaattatgtttggtgacgtaggacaaggggttattttatcacttgttggatttgtggcttataaaaagtttggtttacaattaggtgcggttggagtccgtttaggaatttccagtatgctttttggggttgtctttggttcggtatttggaaatgaggaaattttgattccgttattcaatgcaatgtcgccagacaacacgatgacattattgatcgctgcgatttgtttaggaataattttaattattatttcgatggcgtttaatgttattttgagttttaaaaagaagaattttggagaagcagtgctaagtcaaaatggaatttgtggattagtcttttatatttctattttgggattagttataaatatgtttttaggattaggatttgttaatgttatttatgtagttggattgattgcattaccactatttctaattttcctaaaggaaccactaattagaaaatttgaagaacatgaagcaatgttcccaaatggttttggtgcgttctttgttgaaggattcttcgaattattcgaagtagtcttatctttcatcactaacacaatgtcatttttacgggttggaggatttgttttatcacatgccggaatgatgttggttgtatatacattggctgaaatggtcggtggcgttggtgagctagccgttataatttttggtaacatttttgtaatgtgcttagaaggattaattgtcggaattcaagttttacggttagagttctacgaaatgtttagtagatactacgaaggaaacggaatttcatttaaaactattaaagaggattaaaaatcgaggaggaagtcattatgacagttttagaatttattttaccagcattagtagttatcttattatcattaccattaattaaagtattcacaggaaaagtaagcgtaaaaagcgctaaaattagattagcaactcatgttgctggatttgctggagcagtatgtttagcattatatttggctgctgtaactaacggtgtatacgctgaagaaacagctgtaattactggaacaattgctcaaggtttaggtttcgtagctgctgctttagctactggtttatcagctttaggagctgggatcgctgttgctgctgctgctcctgcggctatcggagcattttctgaaaatgaaaagaactttggtaaatcattaattttcgtagccttaggtgaaggggttgctatttacgggttattaatttctatcttaattatcaacaaaatctaattgaaagaatgtgatcattatgcgattttattgtataagtgataacgtcgatacccaagtaggacttagattagtaggaattgaaggccaagtagttcataaaagaagagagtttcttgaattactagaaacaaaattaaaagatgattcgatcggaatcatcttgatcactactaacttaattgaacttgcgcctgatgttatctcagaaatcaagttaaaacaacaaaaaccattgcttgttgaaataccagaccgtcatggtgaatcaaaaattggtgaaacgattgacaaatatgtttcagaagcaattggtgtgaagttatagaaggggaatgctatggaaaagaaagaacaagtatttctttatatgaaagaagagattgaaagattagcaaatcttgaagaagaaaaaatcttagatgaagcaaagcgtcttgaagaagaagcatacaaccaaattaaagctgaagctaagaaagatgccgaagcattacttgctaaagagttagtagaaatttcttcaaatgctagtgttgaagcttcttcatcacaagaagaaaagactaagaagttagttgaaaaaagagatgaatatgtagctaatatctttagtgaagctaaagataaattagttgcttttgcaaatagcaaagattatcaggcgtatctagttaaacatatggaagaaattgggaaattatatccaatgagtgattcaactcttgaacttagagaagctgatatgaaatataaagatgaattgattaaagcttatggtacagctttagaagtagaagtaagtgataagattacgattggtggatttattgttaaaaataaagctactaatgtcgttgttgatgaatcattagactttgctttagaaaaccaaaaggattggttctataaaacatcaggattaatgattaaatagacagggggttaatatatgaacaataatgtaatttattctattaacggacccgttgtaaaagtaaaagatacagtgtctttttccatgttggaaatggtatatgtaggtaatgattcattaatgggtgaggtaatttcaatttctaaagaatttactaccatccaagtatatgaaactactactggtcttaagccaggtgaaccagttgtttcaactggttcgccaatttgtgcaacgttaggcccaggaattttaagaaatatctttgacgggattgaacgtccactaaaagcacttgaaaaagaatcaggagcatttatccaagccggaagcaatgttgattctttagatattgctaaaaagtgggatgttacaatgactgttaaagttggcgatgaagtcaaaggtggaactatttatgcaacaacacctgaaactgatttaatcgttcataaatgtatggttagtccattgattagtggtaaagtggttgaagtggttgaagatggtcaatatacaatcaatgatgtggtcatgaaaattgaagatgctcatggtaagatcattgaatgtacattatgccaaaaatggccaattaaacaatcacgcccagtcacaaaacgattaccaattggaacacctctagtaactggtcaacgggttatcgatacgctgttcccgattgctaaaggaggaacagctgctattccaggtggtttcggtacaggtaaaacaatgacccaacaccaaattgctaaatggtgcgatgcagacattatcgtttatgttgggtgcggtgaacgtggaaacgaaatgactcaagttcttgaagaatttagtgaattgatcgaccctaagagtggtaaaccacttactgaccgtacggttttaattgccaatacatcaaacatgccagttgcggcacgtgaagcaagtatttatactggagttactttagcagaatattatcgtgatatgggttatcatgttgctattatggctgattcaacatctcgttgggctgaagcacttcgtgaaatttctggtcgtctagaagaaatgcctgctgaagaagggttcccagcttatttaccatctcgtttatcacaattctatgaacgggctggatatatggaaacattaaatggacaagaaggttcagtatcaattatcggagcagtctcacctcaaggggcagacttctcagaaccagttactcaaaatactaaacgtttcgtacgttgtttctgggcattagacaaagctctagcttatgctcgtcactattttgcaattaactggacacaaagttatagtgattatgtctatgatcttgaaaagtggtatagtaaaaatgttgggcctaaatttgtaagtgatcgtcaagaaattgcttatatcttagcagaagaagcaaaattgaacgaaattgttcaattaatgggtcctgatgtattgccagaagatcaaaaattaattattgaggttgcaaaggtagttcgagttggatatttgcaacaaaatgcgttccataaagatgacacttatgtaccaatggaaaaacaattaaaaatgatggaagtaattttatatttaaataaacgttgtaaagaagcggtaaatcaaggtaaagtcgtaagacgtatcgtagatactggaatctttgatcaagttattaaaatgaaatatgatattccaaatgataatattgcaaaattagatacttattatcatgatattgatgaagcaatcaaatctgtagcgtaggaggaaaatgattatgtcattacaatatgtaggcttaaatgaaataaatgggccattagtcgttttagaccacgttaagggtgcttcatacgatgaaatggttgatattcaactaaaagatggaacaactcgagctggtcgaattgttcaaatcgaaggtgaaaaagttgttgttcaagtatttgagggaacaaatggcttgtcacttgaaaatacaaaaacaaggctattaggtaaaccgatggaattaccagtttctaaagaaattcttggaagaattttctctggtgctggtcgcccaattgatggtttaggtgaagtatatgctgaagctgaaatggatatcaatggattgccattaaaccctgtatcacgggtatatccacgtaactatattaatactggaatttcttcaattgactgtttaacgacattgattcgtggacagaagctaccaattttctcagtatctggtttaccacatgaccgtttagcagttcaaattgtaaaacaagcgaaaattgctgatgaggcgggtaaaggatttgctgttgtttttgcagctatgggggtaactaatgacgtagctgaatactttaaacgtagttttaaagaagctggggttatggaaagagtagtcatgttcttaaatctttcaaatgatccaattattgaacgtattttaacgccacgttgtgctttaacggctgctgaatacttagcatttaaacaaaatatgcatgttttagtaatttataccgatgttacttcttattgtgaagctttacgtgaattttcttcaagtaagggtgaaattcctggtcgtaaaggatatcctggatatctatattctgacttggcttcattatatgaaagagcaggaatcatcaaagatgctgaaggttcagtaacccaaattccaattctaacaatgcctaataatgatattactcatccagtacctgacttaacaggatatattactgaagggcaaatcactttagatgttgatttaaactcagctggagtttatcctccagtaggagtattaccttcattaagtcgtttaatgaaagatggaatcggtgaagggtttactcgtgcagatcatcaagatattgcaaaccaattatttgcatgctatgcccatgttcaagatgttcgttcattgacatcagttattggtgaagatgaattatcagatatggataaaaaatacattagctttggtcgtttatttgaagaatactttattaaccaaggttttgatactaaccgtagtattgaagaaacattagatttaggatgggatctagtttcagttcttcctcgtgaggccttagaccgtttagataatgctctgttagatcaatactataatcatgaaaaagcggttgaacgctttaacattaaagaaaagaagattattaaagaattacaagaagaaggtgaataatcatggccttgaaagtagttccaactaaaggtaatctaattgcaatgaaaaaatcattgcaattagcgaaccttggatataatctaatggatcaaaaacgtaacgttttaatcaaagaaatgatgactttattagatgatgtaaaacttattcgtgatcaaattacttcttcatatcaagaagcatatgatgcacttcaagaggctaatatttcaatggggttaattacagatattgttaatagtacacctgaggattatgggatttcaattgcttatcgaagtgttatgggggttgagattcctaagattgcttatgataaacaacccttaaagatgacttatgatattgaacgttcaaattcaaaagtcgattatgcttataattgtttttacaacgtaaaacaattaacagttttattagcagaggtagaaaatagtgtttatcgtttagctaatacgattcgtaaaacccaaaaacgtgctaacgctttaagaaatatttcgattccgcgcttcgaatcaactattaaggttatttcagaagcgttggaagaaaaagaaagagaagaatttacacgtcaaaaagttattaaagaaatgaaaaaatagaagctatgcttctatttttaacatttaataaatttaatttgttcattttttaaagaatattcaagattagctggtagtttagaacgaatatgaattagtttattatcagcaatagtaccattccatgttgctacaacaattatttttttagctaattcttttaaaaatgttaacatatcgatatttgagtccttagcataaaggactcttttattatccaacaaaagaacttctttatcgtagttatcaataaagtcattcattacagtgatgatttcactacaatcatctttaaagatctgatcaagatttagaattggaataccggtttcattgctatagtcatgaataagttttgatttaccactcccaggaccaccgataattaaaattagtttattatcactattttgggcggtggcgatttctgctgttaacgggttcatgggtctgtcctcctttttatattctctttaatccaaaaaaccttgttaaaatcgacttattatctattttcattctatcatttatatttgtcatttcctagcaatatcataattttactagtatttcctaggaaatattgacgatttatagtcattaagtatttctaaagtttttctaaaaaggtgtactatctattgtgatacagttaatgcgatgatataatgaaactgtactatagggaatgatacagttttgttatgaaacatgatattaaaaggagatgcttagaatgaagaaaatgcttacttttttaatcgctacgattttgattttggctatgtcgttgatgccactacaggcaattaccggcataaatagcttagttagttatggtgaaggtaatgaaattgaaggtggctgtaatgggaaaaatgttgatttaggcgaaggactaagcggattgatggtatctaatcaatcagagttagtttttattggtaacgatgattttaaaatcaaagttggtaagccggttaaagaatttgaaataattgatgatgttgataatgatggtcttaaagatgttgctgtttatattgatagtgaagatgattatgatgattttaaaatcgttagttcaaaaacttcaaaagtattatatgctacaaaatattcttataacacgattaatgataataatgaggcagtgaataagaatgccacaattagacaaattctatttaatgataatattgtctatttaatttataattatcatttagtaggaattagtacaaaagattatcaggttgtatttgattatgaagcgaaagataatatttggaaaatggcattagttaataatcaggttatttttacgacacaattaggagaattgggaagtcttaataaaactaatggaaaattaaattatacagttgcattaacaacacctaaagaaattaaagatccacgatatgatactttggggaaagtcaatttaaatatttgggatattgtgtatattaaagataaattgtatgtaactacagaagatgccaaattatatcaaattgatcaaatgaatgggaaaattattaaaacagtaaatttagaagagggtattgatgagaaattaggaaatttattaaaaaacaataataaatggagcggtcaactagttcctacaggaatccataatattagttttatgagttatcgaatggatttattagataataatttaatgttgataagtgcttacttggggagtccacaaattgaattaaatgaaggagatagtgaaaaagaaatacctcatttaatacttattgatcttgaaaaaatggaggttaaactggatattcctgttgagcaatataatttagattatagtagagcggttaaaggtatttttgataatcagcctgctttggttgttccaacgtatgctagtactggaaagttaagacttgtcgcttattcattaaatgatggtacagtattaaaacaaactaatttgaatcttaatggtattaatagtaaaaatgtgaaaattcattttgctaatcaaggagaacattatttattacaagttgacgggggtgtgtcactgcttgttgatcaagatttgaaaacaatagagtacttaggtagtgttaaagttgttaataaagttgttgatcttagtgatggtacaatcgtgtctgttttgaataatggtaaaataacgcaaattaaaaaaatgggtttaggtggccgtgatgataatttagttacgtttaacattccagatggttatcataataatggttttgaagcgattaattatgatgaaaaacataatcatcttttaagtttagtcagtgaactaaacgctaatggtgaggtaattgctagtcatatcgtaattatgaatttaaatgacggaaatacgctggcagataaaaaggtattattagaaaaaggctatgatgaaaataataagtattatgaacattatttaattggtgaaacaattagatattttacagatatgaataatgatggcaaatcagaaattattgttgatgagaatattcttgatggggcatcgttaacatttagaagtgtttataataaatcatttgaaggtgctactacgattattgacgtaggtgatgtgaataatgatggaataagtgatctagtcaatattggtgaaagtgaaatgcgattatattattcgttaaagaatggttatgatataacttatcaaaaaactaatattgctaaaagttatgataaaaaattgcaaaacaatattcatgttaaagtgctaggcgatcttgatcatgatggaatcaaagattttgtaatcaatgcttataatgataaaggctgtcaatgtttccaagtcattaaagggaaagacttatcggtacgatattcattattaaaagatggtgttatctatgaaaatgaagaagatagttttagtgtgacaggaattgattatgacaatgatggagttgatgatcttgtttatggtatttatgatgaaatgaggactgttcttagtggagcaactggtgaaaagttatttgaatacttaattactgattatcataatgattgggataattctatgggtgatccggttcctttggaaaatatagttagttttaatttaattgaaaatggaaatagtgtagttaaaatcaatgatcttaatgatgacgggattcaagagttagcgtatttagttagggattatgataattctgactatggtacaaagaatattctaaagattttaaatggaagtaattatgaggagttaaaaagtaagatccttggtaaaggaaactatgattcgagtcaaattactacagtgatcggacaatcaaaattaatctataatgatggtacattatcacaaatatatgattatagaaatgatagtttagtagcgggattaaaaatggcagtcacgagtgctcgaactttaaataatcagctattgcagcttgaagataatgtagggcagttatatagttttactgatcaacgagattttgaattagttgattttaatgaaaaagatgtaaatgatgggaatttaaaaataagttataaaacagaaaagaatggtttgatgtatgtttatgatcaaggaaatttgattgaaaagacaacagctaaaaactttaatgttaaattattagcaggagagcatgatttaatcttttcatataatgatggtcaaggaaaggttactcattatgctactgtaattacagtggaaaaaagcactattagtcgttatttgattatgttactggtaataggaattgttgctggcggctttggtttagtcttctacccaaaatatcgattaatgaaaaaggcaggtgttaaacatggataaattaattgtgattgaacatatggataaagtttttggtaattataaagcaattgatgatttgtcttttagtttagagggaggaaaaatttacggtatgattgggccgaatggagcaggaaagtcaacaactatgtcattgctgatgggcttgatttttccgaccaaagggagtggtttgatcaaagggtatccgttaggttctaatgaagcaaaggcaataatgggatattctccagaatttcctaatttttatagtgatatgagctgtttagaatatttagtctatatggggatgttgtctgatcttagctatgatgaagctttaaaacgaactaaggaattattagaagaatttgatttagttgaacatcagttgaaacgtgttgctaaattttcaacagggatgaaaaagaaagttggattgattcaagcaatgatgcataagccagagattttattactggatgaaccaaccgctaatttagatccaactagtcgttatgaaattattcaaactttaaaacgtttagtaaagcagcggaagatgacggttttaattagttcacatgttttaacggaattagaaatgatcattgatcatgttattatgatcaataaaggtcatgtagttttaaatcaacctattgatgtagttcaaaatgaatttaatcaagaaaaattacttgtaagctgtaatcataatgagcatttacaaacatatttagaaactaaagggtatttttatacgctcaataatggagttttaagagtaagtatagatgataaacaaaaatgtaaaaaagaaattgttaagtttatttatgaaaatgattatgaattagatttattaaaagaggatacgatttctctagaaggactatatcagcagttagtggaggaaaatgatcatgaaagtactattcagtaagacatttattaaaatgtttaagcttattccggttgttgcgtgtgtgattattagtggcttttttggttttatactatcaaatcaatatcttggtttaatgagtcaaaagccaacttatctttctttatcacaagatattttaatgttttatgcagttttagctttcgttttattagtaggaatgttgatctggattatttgttcgaatagtggttcgggacttttcgcaagtgaaattcacgaggggacaatgagattattattatcaaaaaaaatatcacgtttagagttagtaatcggtaaagtaggtggtatgctagtgggcagttttgtttatttggttatttcttttgcgacattcttaatggtctttattattttaagtggtgttgaaaaagatatattacggatggtattagcagctactcttgccttcattagttatggaataattttaatttttattcttgggggattagcgacttttctatcatcatgttttaaaaagaaagtacctgctattttaattctagtagcattagctgcactaatttttggaattatcccttttgcccgaattttccttacgaatactggaaaatatgatacctatcatttatatttatttgatattaattatcatctttcattgatctttaatcaatttttaatgctggttggagattttaatacaatgttaggtgatctaagcatgtttggaatgttcacaaatctttactcatatggtgtaactgattttgatttaggaaatcatgctgtttatacattgaatcagtcactaaatagtggtttgattacagcagtttatctagccttagctagtggactgtatgttttatcttatcgccggatggataaaaaagacatttaatttagtactatataataatacaatgaatcttattatttgagtaatgtttttgactaccgcttttttagtagcaaagctgtatatccctttgaacaatagaggttcctttacggattataaaactagaagttatttacataataattttctagtttttttatgagaacttttttcaaaataagattaataaacattccgattaaaatctatgatattattaattagtaggaggattgagcgatgtatctagtatttgatattggtggaacagcaataaaatattgctggatgaacgaagcgggagaaatttttaataaacaagaaatttcatcaacagcagtagacagcttagataaatttatagaaacagttgctaaaatataccacgaaagtaataggaaagttgaaggaattgctttatcatgtcccggtgttattgatgcagctaatggaacgatcaaagtcgttgttgcgtatccatatttacagggaatctgtttaactgagctaatttctaaagcttgtgataatataaaggtttctttggaaaatgatgctaagtgcgctggattggctgaagcctggattgggagtgcacaagcttatgatgatgcaataattgtagttttaggaactggaattggtggagcgattataaaaaataaacaaattcatcatggtgcacatttatttgctggtgaaataagtaccctgatcgttgattatgataaagagactaatcaagtattgacctggtcggacattgcttctacaacagctttatgtaagcgggcagcggaagctttagcagtcacgtcaattgatggaagacgtgtttttgaattggctaacaatgcggatgaagttgttctggaggtactgaaaaatttttgtctggatattgcaatacagttgtataaccttcagtatagttatgatccaggagtaatctgtattggtggaggaatttctaaacaacctctattgatcaagctgattaaagaggcggttgaaataattgctaacgagactaatcagctgcttaaaccaaatgtaacgacatgtaaattttataatgaagcaaacttaattggagcgctatcatactttcttagcataaaataatttgtttttttaccctaaaaaagtatcatattatcatcaatagtgttatagtataaaaggtgaatattggggaatgttcattcagtattcttattaaaagaaacatattgatgttaaaatgaatatggtttttaggaggatgatttatgggtgtttgtaaagttaaaaatattgtaattggtgagggtatgccaaagatatgtgtaccagttgttagcaacaatcatcaagatatcataacagacttgattagattacagtcattagatatagatttgattgaacttagaattgattatttcaatgaactgttagatcatcaaaaattaaccgaattatttaaagcaattgcttcaatggcaattaaacaaggaattattttaacttaccgaagtgttcctgaaggaggaaatggtaaattaagtaatgatgaatacatgcaattatattcaattgctcttgaaagtggagcatttgatatttatgatgttgaattatctagtggaactaataccattattaatttaagtaatttaattcatcaaaatgataaaaaaatcattatgtctagtcatgattttactcgtactcctagtattgatacaatgttaggaaagataaaacaaatggattctttagaagctgatataattaagattgcagtgatgccagaagactatcgtgatgttttattgttattagaaacaacactaaaagctaatgagttatatgataaaccacttgttacaatgtctatgtcaagcaaaggaattgcaacaagaattttaggtgaacaatttggctcagcgatcacatttggaaaagataacaatagctctgctccaggtcaaattgaagttcatgctttaaaagaagtgttaaaagtgattcaccataataattaaggactatatgtccttttttttgcacctttttataatttacacataaaataaaataggtggttaaatgttaataaatcagaatgaattagaaaaattatgtaaatatttatatccaaaattttttgattataaagatattagcctttatgacttaaatattaagatcgacgactatttacatctaagtgcaaatttaaattattataatatagaaacaaagctgagagcaatagctcgggtaagagtcgaagataagattattattgatataaacggagttattaaatatggatttattaatttagatttaaataaagttttaaaggaaacggtcaaggatttgccatatttaacaatcaatgatgaaagtattattattgataatgagtatgttcgggagatatctttaaaagatgaatatataaatatagaactaaaataatcgtaagattattctagttctatttcaacatgataaatccgaccccagagataaatctgatagaaatatgctaataattgaggaccagtcatcagttgaccaaaccatggatatttaaaggattctccgccactattaattaaatcaattaatttatcacggttaaataaacgtagaagtagattattttcatcatttaatgattcttttaacaattctacgattaaatcacgatataatggtgaatgggttttaggataaggattcttttttcgattatagatatcacttggtagaaaatctttaaaagcatctcgtaatagacctttttcaatatcattgtgatacatatattcccatggcacattatataaatatgaaacaatatctttattagcgaaaggaactcgtaattcaatagaactacgcatcgtttgactatcagaacgagtcaataaagtctgcataaaccattccatatttaaatagatcattttacgcttattagcatcttcataagtatgatcatgataatcaatttcgtttaatgtttgatgatacttatccatgacatagtttttgatattcagtgcttgaatttcatcagagaatagttccattcgtttatctaaatcacgcatccatggaaagccgtcaatactgtaaagttcttttcgataaaaccatgggtagccaccaaaaatttcatccgcacattctccggaaagtacaactttatgattatgagaaatttcttttgaaaataataagaaacttgaatcaatatctgccatcccaggagcatcacgcgcaatcaatgattcttttaacgacatcactaattgtttttgggataaagttactgttttatgtttggtgttatacagtgtttttacttcatcgatatagtggtcgtcacgtgttgtttgatactcataaggctggaagtatttgtcttgatcttgatagtcgacactataagttgataatttggaaatatattggctagtaacaccagtgatgatcgaagaatcaaggccgccagatagcatgcatgatacagggacatcgctcaacaactgttggcgaatactatgatttacgagacagcggatatcatgaactgtttcttcgtaactccgattatgattacgtcgctcaagtgcccaataacgattgatttctttgtaaccgttaaagacattcatataatgtgctggtcgaagactatagatatctttataaatagttttaccaggcgaaacacttggccctagtcctaataattctttaagtcctgtttcatcaacgacacaacgtcctaaatacattaaaatacattttatttcactactaaaaataaataaatcatctttttgataataataaagcggtttgacaccaagttgatcacgagccacaaaaagtttattttgatatgaaattacaaaagagaaaattccatcaaataaattaagacaacgtggaccgtaagcaataaaactagcaacaactacctcggtatcactttgactagtaaaatggtacccttcatcaattaattgctctttgatcgtattcatattgtaaatctcaccattatatacaatcgtatactcaatatcattataagtatatttaaatggttgtttaccgccatttaagtcaataattgataaccgacaatggcctaataaaacatgttcactactggcgatattaaaatcatcaggtccacgatattttaataatgtaagcatcttattaaagttttgaacttgattagttaaatcgttcatatagtcatacatacataaaaatccacacaaattaatcaccccgtatcattatatgaatgatactttttattatgtcaaaagataattttaaccgtgttttctttttttgattctccataaaaatgcgaaaaattaggtatatcaagggttttgcactagcgtgaaaaatcacggtgaatgtgataagtaatagaaaatatcaccttgtctctaactttggtcaaagtattgtgtaacggctttcaaattgatacgatgtatgtgtcaagagaaaagggaggacaaaatatattgcaaaaaattcaacgttttggtggggcaatgttcacgccggtactgttatttgcttttgcaggaacaactatcgggattggaacattgtttacaactgaagcaattatgggtggtctagctgaccctaatggattgtggtatcaagtatggaatgtcattcttcaagggggatggacagtattcaatcagttaccattaatcttcgtggttggattaccaatcggtcttgcgaaaaaacaacaagcaagatgttgtatggaagcgttagtactttatctaacatttcaatatttcttaagtacgatcttaagccaatggggaggaactttcggagttgacttcgcagcagaaactggaggtacaagtggtcttacgatgattgctagtattaaaactctagatatggggatgatcggagcgttaatgatttcatgtatcgttgtatatttacacaataaattctttgatactgaattacctgaatggttaggaacattcagtggttcatcattcgtagtaattgttggtttctttgctttattaccagttgcatttttatctgcatggttatggccaatcgttcaagatggtatgcgtgcattccaaggatttgttgctggtgctggatcaatcggggtatggatctttatcttcatggaacgtatcttaattccatttggattacatcatttaatgtatttcccattcttctacgattcagtaattatcaacggtggagtttattcagcttgggcaacagctttaccagatttagcggcttcaagtgattctttaaaatcattagcaccttgggcatggccaacacttacaggtttatctaaagtatttggatgtccaggtatcgcactagcattttatgcgacagctaaagataagaagaaaaaacaaattgctggtctattaattccaatcacattaacagctattgtttgtggaattacagaaccaattgaatttacattcttatttattgcaccagtattgtttgtagtacatgcagtattagctgctactttagctacagtagcaaatgcgctaggtgttgttggggtattatcaggtggtttgatcgaaatgtcagcccttaactttataccattaatggcttcacactggcaaacatatttaacattattggtagtaggtttagtctttacaggtatttatttcattgtatttagattcttgattttaaaatttgatttcaagacacctggtcgtgaagatgatgaagaagaaattaaattccacactaaagctgattttaaagaaaaacaagctggtggaaaggtagaaaaacaaagtttagctgctgctatccttgaaggattaggtggtaaagataacattgttgatgttactaactgtgcaactcgtttaagagttaatgtaaaagatgaaaaattagttcaatctgatagctattttaaatcaattggtactcatggtttaaaagctactaagacaaatattcaagtaattgttggattaaaagtaccaagtgtaagagaagattttgaagcattactataaataaatgaaaaggatggtcttgaagatggcaaaaagaattaatgaaaagaagttaaaaagattagatcgatattatatgatcgctaaagtgttcttaatggttacaccgtttattgcttatctatatttatcgttgttagcgatgatgcgttcaattactttgccagaagtgctgagcagtgagccaagtgtagcagtaattttcttgattgcaatgattaatccatatattgcttatttactaaatattgcacaaagaaaattaaaagaaggtgacattaaatttgcttgtattaacttcgtattattgcttttagctcaggccttaacattaaatagtttatattttatgattattgcttacttgttctatgtaacagttaaaacatatgatattaaagtattcaagacccttaaggaatttacaatgaagtacactttccagtatggtggaggaagcttcattgtagtagccttttcaaccgtttgtttatttgcgacgcttagattaatgtaaaacagaggagaaaaagaaaatggaaaagaaatattcagttgttattgctggtggtggaagtactttcacacctgggcactggctgagatgatctgcgctttgatatcatgcgttttgaatattgcggcaatatctctgatcagctgcagtccgtccatcgagatatcatcgattcttccaacaaatggagaaacataggttgctccggctctggctgccaggattgcctgcggaacattaaaaatcaatgtcagatttgttttgatcccttcaccggacagtacccggcatgccttcaagccctcagcagtagttggaagcttaacaaccatattcttatggatttttgcaatttcccggccttctttgatcatgccttcagcatcaacagttgtggctttgacttctccgctgataggaccgtcaacaattgcagcaatctccttaattacctcattaaagtctcgaccttctttagcaataatagagggattggtagtaacaccacaaataacccccatatcatttgctttttttatttcttcgacattagccgtatctaaaaaaaatctcattttatttttctccttatatatattgtgataacacttctttttcacattcattaataacttttataatattattctggttattacatgattccagcttttcaatcagctttgcatcattgaccattcgcattaatttaacaattgcaggaatatgttcttttttatctttactcgctaaacaaaagataaccctaacttgtttattatcgaaccatacgggttcatcagttacaatcagactcattgaacttattttaaccgatgatgtgttcccactatgaaataacgcaaatttactatctgttacagcataaaaccctgattccttaatgacactcatcaagccttcataatattcagatttaatacatccatgttgtattaaaatatcagttgaaagtttgattgcatctttccaattgctaaatgatttaacataacgaatacaattttcacctaataaatcacttatattatagtatttcttaggaatcctaacatctttatagccaagttcttctttaattatttcaagtactttttcacgctcaggagaatttaaaaatcccaatcttttttcaattgcaatataattcgttaaaacattcttttttctaattcccaccgcttctaatttattatgatcatgattatcaaaaattgcatttacaacaatcaaagttttttttactgggaggattaactttgacgttgaaataacaatatctatttgctcccatttctgataatgctctagatcatacgctggaatactatcaatcacttgaacctgatattcatttcttagagtatcttttaaaagtgctgtagcaccaaaacctaagccacatattagtaaaatatttttatagtcatttgctcttaatctttgaatacttgcaataaaatgaatagtaatataaattaattcttcttgactgatctcttgtaacggttgaatactcaatacaattgattttaaaacttcaaatacatattcataactttgtggaatcactgtttgacttaactcataaactcgaatattattttttattcgttccaacatcggtgccacatgattcaataatccttttattaaaatcatatcccgtaaaaaaaatactcctaactcatcagacatcattgtcacaagttgaattataatatcttcagtcattattaaatccaaattgatatcaacctcaccatatttattagtataactagaataactcataattagttttttttgattatcatctaattgtttattaattatcatttccagttcttggagtgaataatcttctacatcaatttttttaggacaagatggcaattgcttctcttttataatataccagcaagtagttaatatatttgctacataccaatcaaacgaatcatcactaaaagtccaactcatcattttcattttattagtgatccagtcataaatatgaagaatatcaaaattatagattctatataacaatttcattaattctaattcaaatgtattatattcagaaagtttattactaaataaatagatatatttttttaactcattgacccttaaaggatatcccttatgatcatcttcaattaaatgaaaatgacgattatagactagcgatagaccatactgattaaattctttaataagagtatccaaatcattttgaattgaacgacgcgatacttgaaatttttcacttaactttttaatatttagactatgaacatcaaacataataataaaacgtaataattgcatcctctcatcagctgaaaaaataaattcactatcttctaataaaatatttaaatctaaatcaattgggacaattaattgtcctttagaacgcttttcaatttcagacaatccttttaaactcaaagcatcgttaatacaatctatgtcgtaacgtacattacgttctttaagatctaaagcattgccgatttctttataactagattcttttttttgatttaaaaatctaataattttaaacattctagcactaatcatcccaatttcctccgtttatttttcttctttttctgctatatctaaatttggctttgtaaaatgtaagattgctgcggatactaatactcctaccagcatcgctaatacataccataatttgccattgactactggtaaaataatcaaaccaccatgaggaactaatgcttcgactccattcatcatccctagtgccccacctactgcactaccaataataattgctggtaaaactcttttcatatcttttaccgcaaaaggaatcgctgcttcagtaattccaatcgttcccatgaataatgccgatattcctaaattcttatcatctgcactatattttttacgatcaataaaagtagataaagctaatgctaatggcggaattgcacaagcaattcgatgagcaccatttggagcataaacaccttctgccatcaacgcaagagtaaatgccgttgccgtcttattaattggtccacccatatcaactgctgtcattgcaccaatgattgcacctaagagaactgcatttcctccttgcattccacttaaaaatttaacaagccagtccatacaagctccaatcggaacagaaataacgtaaatatagataattcctaaaataaatgttgtaaaaataggaacaattaaaataggcatgattgttttaatcgtatttgaaactttccatgttttacaccaacgaactaaataaccagttgctaaccctaaaatcattgcgcctaagaatcctgttttaacctctgattcaccaattggattatttgctacatatcctaagatcatccctggagctatcccaggttttccagccaatgaataagcgatatacccagataaaattggaatcatcatagcaaaaccagctgatcctaaatcatttaaatttttcatgaaaggattagttacttccattccagtatccgttgctgtccctgttgctaaagcaaccgctaatagaatcccaccaaccacaactgaaggaagcatatacgaaaccccagtattaaaggctttttgaatatctttccatactttattatttttcataacttcttctcctataagttttctgcttgatctataaccctaacggcatctttaattacatccccaggttcgacttgaattactttaccagcatcttgtttttcttcaaaacgttcttcaccatcgatccccactgcaattgccaaaataacagcatccgcttcatcaatttcctcttgttctaattcgttttcaatccccatacttccttgagtttctacttttacttcgtaaccacgattacgacattctttttcaattgcttcttgagccatgtacgtatgcgcaataccggttgggcatgctgtaactgcaacaattttcatattcatttcctcctataattgttcattgattgcatttaatgcacgatatgcatcttcaacatcttctacttcaatcaattgctttctaaaattatcatctaaaagtcttctacttaataaagaaataaatttaagatgaatattattttgattatcttggggcacgcctataaggaaaattaattggactgattgtttctcatcatgattccaatgaaatgcatcctttatttgaacaaatccaataaaagcacgattaacagtatgactaattccatgaggaattgcaatttggtaaccaattgaagttgaagccatttcttctcgtttataaaccgcttctttaaaatcttttttactattaattaaatctagtttaatagcctgatctgataataattcaataacatcatctttagtcgataaagcttgctttaagaagaccatttccttatgaattgctttttcctgcataatcattccccttatccttttttacaagcaagcatctttgatgttaatccttccatattaaaacatctaacatgtttttgcatttcttcttttagtttttcaataacaaatctttttccatcaattttaatgcttgctaagttttcatataatttattaatttctaatgctactttaggtttagaataagtataatgaccgcataattctgtaatttgtaatgttgtttgctcatctaaattatctaaatccgacatatctacttcatcagtaagccattttttccatttcattgaatgaattgattcatacttaataacattttctaaatttgatggctctttaatcatattaaatttagcaaactgtttttctacttcaattaactctaataaagccatcgtttcaatcgttccaaaagctggagcaacattcattgctgtgatatttaaaggtaaatgtgctagtaatttagcttcacttaaataatcaccattatgttcctttaatcctactccatatttagttgatattgcacttaattctaaagaattttcataactgaaattcccaacatttttagttaaacgtgttaacgttccagtttgaccaacgataaaaattggcattggtaaatcatgttcttgagtataagattcaattctttggataaaattttcatagcgatccatcgaagttaaaccaccacttgtttcttctgtccctacttcatatgcaatttcacgttcaattccatattcttttctaacttgctcacaatactcaattaattctatagtacgattaaagacaacatctatatccactactttacaatattcatcaggatccttagttggatcaatatgtaataaatcaaaaccatttaaaatatcttctttatatgactctttggcaattgccatagcttcatcttccggtaaatgatctgctctttctttatctctttgccatggtccaccatgatcacggcataaataatagacattatcataattaatttcttgcgcaatctcttcgattttttctttgaataacttttgatcactgttgaatacatatccaccaccaaatttatatgcatcaacttgattacgacttgcaatatacattaatggaaaatctttttcttttgaaatttctaaagatgcccgtaaaaaattttcagacataggtccaatcccaagtaatgtatgtttttctccttttgaattaattacataattaactgcttctctaattgtaacttttttattcatttttatcttctcctcatcatttagcaattaatcaaatgtcgacttttgatttatgagataggtatttgtttctatctacacatatatcatattcaattagtcacaatgacataagataaaacaaatgaaagaaaaagttacaaaaattgcaccctattgttgattaagaaaaaatagaatttaaactcaactagaacataaattctatttttttaaatcagcatcgctgctaataataaataattaatttttcttcatataaaactactatcttttaatcttgatgacataataatagcgtacctaataacatatattcttggagataatcaattaaaacaatttcaggaatataatctttaggaatatatttagctacctcttttttcaattcttcaatattagtaattaaaaaacaacatataacaataatttgcggatctaaaaaactgattattgatgtaacagttttagccattgcttcaatggctccttctggtgtttgatgtaattctaaaacatcttttgaatatgataatggcaaatattgtatttctccagctacatgatggtgtccagcaatcaaacgatcatttacaatatgtcctgcccctgagttcgaactaaccggttgaaaaacaaatgacagtgatgaacagttttctttagaactataatagcctaaagcaattgtattagcatcattactaaaaacaaatttttgcgaatatttcaaagtaaaatcatgagtaattgaaattttctctagcccctttatactcattgagataatctgatcaccacgtataattcccggagtcgataatccaataactttaatatctacatatttagccagcatgctatcgattacatcataataatcttggattgataaagtaggtttgataatttcattattttctaaaatactattattttcatcatataaacggtacacaatatgaacacgattactattcctaattaaagcaagacacaatgttttaacaccactaggctgcatatttttagctttcaacggtttatgcattccttttgccaaggttcgtttataattacgctcctcttcaataatcgataacatcttttttacatcatatttagcaaatatagcaggcgggatatttaaaacgattttattttttaaaatctcacatacctttgcatacatatatgagatttgtggtgccaacataatcatgtcataatcttcactagccttataaagattattatagctaaccgcagacacttgaacatcgatattaagtaactttgttatttgattgatccgatcagcaaaataacctgtcgttaacccaccagtacaacaaagtaaaacttttaaagctggtttatttgttaattgcttgatcgtttctaacatttcatcaaataattgaatcgcatgtttgatatttttaatttggaaatggagataaaattcaacttctttttttattaaattttcaaccgaaaattcaactatattcatattataaaaattaacctggctagtactatatttattcttaatagcaatcgttttataatcatccgatagacttatagctaaatttttattactttgcattaagatccactgtttaaatacctctatataaatttcactcaagaattcatccattttttcactcctttatcttctaatgattttaatagtccctgattatacatacctttattatattataaaattcatagaaaagagaccaattgccgttattctgataataatttttcaatttaatataaaaaaaggataaaaagaaataaatttctttttaatctccaatttaatctttataaaaatcataattaaacattaattttggcaactattaaaagaaacaaagctaccgccttgtttctctttattcctacataaccgtgataatcgactttccagccgttacttcaccatatttttctaattttaatgtttttcctttagtatctagaaaaacaatcataattgtatagtcaatattttcatttcttaaataattaagatctagtttaataattttttcaccagctccaactttttgatttttcttttttaatattgtaaatccttttccttttaaattaacggtatctagtccaatatgaaccaagatttcaacaccgtcatctcgtgtaattccaaaagcatgaccagtaggaaataatgtcgttaatactcctgagcaaggggcacagacctctgacgaggtcggaacaatagcaaccccttctcccattactttttttgaaaatacattgtcatcaacatattcaagattaaaactgactccatttacaactgcatatacattatttgtatttttttgattattttttaatgatttaaatatctttatcatagtattaactcctaaatttgctaatgactattttgttggaagtttttattttttactggaacatcttcaaatcctgagaaataactcaccacactagatacaacaaatgccgcaataattgcgataatgacgccaataatcgtttccccataaataggaagtgccaaaatactaggattaccataagcaaatgcctttactccaaaaaatccagcaatacaaccgccaactgcaccaccagccataacaccatacattggcttttttagacgcagattgattccgtagatagccggctctgataccccggctagaatagccccgacaccactactaatcgcttgtgaacgtaattctggattcttagtttttagtgctaccccaaaacaagctcctccctcagcaacattatgaacaaattgtgttggccttaaaaaaccttcataacctaatgatgcaatactttgcatcattacagggccaaaaacagtatgcattcctgacattattacaaatggcaatacaccaccgagagctccaagcgcaaatggaccaatcgtgctttgcatccaaactaagaaattaataaaatattcaccagcaaaaaaaccaattgggcctaatacagtaagggttaaaagacttgcaagaacaagcgttaatccaccaacaaaaattcctttaaacattcccggtaaatacttattcaaaagcttttcaatatttgcaactgctacagttgataatattgctggtaaaaaagatgaagcataacttgctgaataagctgtgaagcctaatatttttaagggctcttcagcacttaacatcccaataatatctggatggatcagtagacaagctactatcattgaataaataggtgtacttcctaatctgattgctgcaccgtatgctacaaaaacaggcataaagtagaaagaagtattaacaataccatttataactagatatgtttgattatcaacaatttccggccacgctaatgaggttagtaccaaaaatacttttattaatccagctacagtaagcccaggaatcattggtgtaacacatgcagataagaaattgaaaatattttttattcctcttttccaaattggcgaatcatctttttctttaatatcttcatccaaaatttcatcaataatttctgctacttcaaaattataatttttaactacttgagtaaatgtcgcagataaatttttccccataattatttgaaattgaccggcaccaaaggttgagcccaacactccatcaatttcattaatcttatcttgattaactagatttttattttttaatacaaatcgtaatcttgtaacacagtgggttacatatttaacattatcctgtccgccaatcgttataatgatttgatcggctatttctttataatccatattattctcctctatattattcttgaaatatgtactaataaataaaatcgttccgcctctgatagtacataatcaaattcttcatttaaatatctttcgattgaatctaacgtaatacctatttttttattaatatctgacttagcacttattattaatttttcaaaattctcatcatcactttcaccctttatcacccgctgcataaaaaatttaagatgaatcactagcctagaataatacagtgaatcttcctgtagttcaagaccaagattagcttcaattatatttaaaatatcatctatgctctttaaaatactcgttgttttgcttacattattattaaactcagcattaattaagtgaaatgctatagcacttgcctcttttttatttaaatttatttgataatatctattaatcaaatctaatgctttaaggccgacttcatattcttcatgatagaatctttttatttcttcactaactaaactataactaccataaccctttagataatttttggaaacaaagttaatatggtctgatagcgatactaataatccttgattaaaatttctatttaaatcagtttttgccatatctataatttcttgggtcaattcaatacatttaaatggaatttcattcagtaaggctttaaattgaattttcaataaattattttgtaacgtataaagcttgtaattttctttcattgttatataatcattaactttatgattaaatcctacgccattaccaataataattatttctgttccattttctaatatttcaatggcattattatttaagattttattaattctatagtatttatttttcatatctaatcctctacatttattaaaatgttaaatcagacccgtttgttttaattaccttcttataccaataaaatgaatcttttctataacgctgtaatgatccttgtccataatcattcatatcaacatatacaaaaccatagcgtttcttcatttgtccactagctaaagatattagatctgtacatccccacatagtgtatccaaaacatggtactttatcaatgacaatagcatctctcaattgttttaaatgttcagccacatattttattctgtaataatcatgaatttttccattttctaaaatatctactgctcccattccattttcaataacaaataatggtttttgataacgatcataaatttcatttaaacaatagcgtatacctaatggatctattcctgcaccccattgggtcttttttaaatacggattgggttccccacccatatgatcaactttagaaccagcactaacaattgaagaacgataataactaaatgaaataaaatctaaagtatgttttttaatcaagtttcgatcttcctcacttactttcaatttgacatctttcttattaaaaatatcttttgtataatttggatatgacccgcgagccattacatcaacgaaaaataatgcttcacgtcgcttacaataagtggcaaaaacatcttcaggattacatgtagctggataaatttcgcttaatgcaaacattgctccgaattttatgtctcccataattttctttccctgactaattgctttagcacttgctacaaacatatgatgaactgcttgatatctcgtctgactatcttgtttatgggttcccatttgagcgtacccacctaaattatttatttcattaaaagtaatccaatatcttactttatctttaaatcggttaaatagtgttgttgcataatttacatagcatccaatcgtttctcgccccgcccaaccatcatataattcacataaatgaaagggtacttcatcatgacaaattgtaatcattggttcgatattatattttaaaagttcatcaattatcatttcataaaatttcaaaccatcttcatttgctttttcttcatcaccatttggaaaaattcgactccatgaaatagaaaaacgataaactttaaatcccatttctgcaaacaaagcaatatcttctttccaatgatgatagaaatcagtcgcttgatggctcggataatatatatcatcataaatatacggtatagctccatcgggaattgagtctcgataatcaatactccccctcgttccattatttaattttaaagtaatttgtctttctttatctatgtcaccagcagtttcaaaatcatgactcgataagcctcttcctttttctttatatccaccttcatattgaaaacaggctgtagcacctccccataagaaatcttttggaaacctgatcattttcttacctctcttcctctctaatttgccaatataaaaagggcaataccaaaaagaagctaaattcttttttggtattgccccttgtttttcccgggtaacaagccatatttaattgacacttatattttatcatataatttattttttgcaagggctttcaaaaaaataaaactatttacaatattttgcttattaaaagtaaaagcacaaacacataggtaaagagactaagtaaaacagctccaatgtatctaattatcaaaataccagtgagagtaaatatgccttttttgaatttggaatttctatcctcataatcattagaataaagtcaatcaaataaatatctaaagctattgatgaaaacaatgttttaaaaagatttgattctaaaatgattttctccatttacaacatagtcacttatcacatagatgctaccagcaccataaagattgctccaatattaaaagtacttaaataagttactgtcaaagatggcattatcgcttgaataaacggcaaaacaaaccttccaatgttatatacagaagcatttaacatagagacacctttcattgttttggaatctcttaatttaacatgatagccaacaaccgccataattatattatttaaaatttctagaataataaaaagcatgatatttgatgtcaatcgaatctcacggttcccgcaagcaatgtccatggacatgtaatgtttgttataagtaaagcaagaacatacgaatcactttctttaatatatcctcttaattttataaaacatgctaaaaagataatcaaaataaataccattgcttgttgtattactgacgtcataaatttttatcttctattcttttgtaattactatgcttatacttgatgtatcgattttaataattcaatacccgtttttgttttaaatattttttccataaaatttcttatatcttcaacggaataattgctgctgtttcaagagcttttaagtcttgctgattcagttttactaattcaccaatgttttagcataagcatgcacttttaagaaatgtttaatgttatagttatttccattagcatatttaatcattttatttgcaatattataaatcatcacaatccttcttaatctaataattaatcctaataaaagaataatcttcatatctattaaaataaagattttttatattctcacttattttcattatttaataaaaaaagcgcaactaaattacgctctaaacttttatatttttgatagcagtacgattgtctcaacatgactagtatgagggaacatgtcaaccggatacattacctcaccacgatagccaatttttgcaaaatacttgatgtcccttacctgagtacttggatcacaagaaatataaacaacttgtttaggattcaagatttttacagcatccataaattcctgcgtactgccactgcgtgggggatccataattacacaatcaactttttgcttctgtttagctaatttaatcataaaagcagaagcatcatcattaataaatttaatattttcaatcttattcattttagcattattgatggcatctttaactgcatctttatttaattccacaccagcaacttccttagttctattagctacaatcattccaattgtcccaattccacaataagcatctataattctttcttgacctgttaaattcaataaatctagagctttagaatacagtaattcacactgttgatgattaatttgataaaatgattttggcgaaatcttaaacttcaaaccacacaattcatcaactataaatcccttaccataaagaatcttttcttcattacctaaaaccacactcgttttacgtttatttacatttaatacaaccgtcttaatacttggaaaatttttaatcaactcattacaaaaatttttggatcctttaaatacattatcattgcaaactagtactaccattgtctgatcagtaacaagagcacgtcgaattaatacatgacgcaataatccgcgattacgattttcatcataaatactaactcgatatcgttttaataagctttgaatcttcttaataatcatatcactgagttcttcatgaagaagacaacgatcataaggaataatcttatgactatcctcttcataaaagccaaattcatatctatgattaaaagcaacaattattttattacggtattcataaggatgccccattccaatagtatccttgacttcatacatgtctaatttattatcttttaacagcttcttacaataatctgttttaatctttaattgtctctggtaatcagtattaatgtatttacagctaccacatttcttctctattaaacatttcattttatcacctagcaacagtataacataactaaagcaaaatactaatcaattccttctctcattattatttcttcataaataaaaacaaggtatagtttgttaccaaactatacctactattaatcttcagatatctcttcttcaatgtgccccactacttgaaatgacttatcagtatactgcataatttcaaatttattaccatcaggatcatgcacccacatttgataggtatgtgatggacctttagaaataggtgtatctattgcaactccacattcaactagttctcgataagttttttctatatcctcaaccaataacgcaaagtgtgaataccccagcctctggttccactcatcatgtggcgcttgtccttcatcctttggaaatagttcaataaactgtccaggggcaatttcaatataaacaatgataattctgtttggatcaacttcagctacttcactatatttaccacgatttagtcctttataaagtcccgcccttgttacaattttaacttttaatcctaacttattttcataaaagtctctcatcacatccatttgatcagtgaaaaaagatacatgcatcaagcttttaaattccatttgtcttctcctttaattatcatttgtaaatactattttttcttgatttcttgcctcattcatgactttagctactattaaacttaattccagcatctttttagcaaaatcataatcattattatcaatgattctaataaattcaataaattcataatataagcgatgttcacaatcatcaactcgataaatttcttcagtgccatcgttaaaaataatttgatatccggtcatctgattaacaggtttatcaattttaataacccctttatcaccttgaatcgttgaaataatcggtgctttgcaatctttagcccctatacttatccccttaaacgaaccataatcgtacattagaataccacttgtatcaatttgattctcaatatttgccatatacccaatacttaccggttgaccaaataaacttattattgcattaacattataaacattgatatccatcaaagctccacctgatttatgataatcaaatgccggtaaaattgttccttgtttaaaagcatcatatcgtgaagaatattgactataattaaaattcatgattttaatatttccaattctctttatatcttctttcaattttttaaaagcaggtaaataatggatattaactgcttctaaaataattagatcgttttcttgagcaatttcttttaattcttccaattccttaacatttgaagtaataggtttttccattattacatgcttaccttttaataaagcttttttagcaaaactaaaatgtaaatgatttggcaaggcaacatacactgtatcgatttcacttcgcaacatttcatcatagtcataataacaatgatctagatgatattgcttagcgagaatagtagtctctttcttagtttgttcagtccctaaaatcgaaattgattcaatctttaacttatttatagttgttaataagtctttaacaatcatccctgttcctaaaatacctaatttcatttaatttgcctccctaattatttctgttaattccaatatcctttttgtatcttccaaactatgaagtgcactctcagttttatgagctcgtacatcatcaataaagcactgaatctccatagtcatatcatctccaataattggataattgcgttcaaccacagtaccatcattttttatgattttataatcaataatacgattaaacattggaatctctatttttccaaattcaccttcgataattgctaaacgctctttattacgatcaattgccccttccacaatcgcagtacattcattattaaaattaatttttgctttaaaataccattcaactccagcaacaatatcaatctgtgaattaatattctttatatctgaatccaccaaagctaatacaaaaccaagcaaataacttcctacgtcattcagtgccccaccttgatcaacgttaaataaatatgaggtagtttggtgagcagtagcatcaaaacaaaaattagcttcaatttgtttgattttaccaatcaatgataaatcctgttttaaatgttctaaaccaatattaaatttagtctttaatgcttctaagcaatatcctttttccgtatatacttttgttttaatctcctcaatatctgcaactgtcaataccattggtttttctgataataccgcaatatgattatcaagtgcttttaagatccattccttatgatatttatgaggtaaggcaatgtatacagcatcaagttctcgatcctgtaataattcgtcataatcttgatatattttaacttctgggtgagcctttacatattcatcatcacttgttaaggaatgagatgcaattgcataaatctttccttcgtcagtgtattcaatacttttaacaaattttcttgcaatattcccaaatccaataattccaaaattcattgattttgcctccttttccttgttataacataactatttattatttaaatatatttataatattctggaaacaaagtactaagaaaataaaaaaaatactgtgatttttgtacttttagtacaatcacaatacttttatataaccgtcataatataattgacccataaccagctaattggcataacaataaccattgcaggaatcatatccgcaattggaaattctttaaccttgatcattctaaatcctgtagcaatcattaaaaagccaccacaagctttaaaatcattgatcattgctggtgtagtcaatggaaaaataaactttgctgataaaaataaaataaaaaagattacaaactgcggaatggcaattacagataccacataccctaaattacaagcaaaaatcgcagcagtaaaaaaatcaagaattgatttagaaatcaaaactccattatcacccgtcattcctgaagttaaggagccataaattcctgttccactagcacaaaataacacaataatagtaattaaagtagattgaaactcttccgaacttaaatcactaccattatttttaaatattttggcaattggcttttgcattaaaattgctcccttattgatccaatcactaaagtgcagtgataatcccacaatagttccaataattattgaaaagattactgccggcatattttccattaatccaattgcattgattcccatagccatagcacaaatcccaaaaatcaaggttatttctgtcttaagtctatgacttaatttatgacctaataatgcaccaaatattccccctaatacaattgataaactattaataatgactcctgttggcattatttttccccctttataatttgaaaattatttctctaaaagattccattcactctctttataaagaatatcatttttattagataattgccaattaaaatagtttcttgtcttattaagaaaaaaaaggacataattctataggctacaatatttgaaccataaaatacatgatgttataatataaagacaaaaaggagatgaactatatgacaaaagtagatattatatctggtttccttggagctggtaaaactacattcataaaaaaattaattagtgatgtatatccaggagaacaaattgtcttaattgaaaatgaatttggtgaaattggaattgatggaacttttatgaataatgctggaattgaagtaactgaaattaattcagggtgtatttgttgcagtctagttggtgactttgaagcttcattaaaagaagtattagaaacatatcatcctgatcgaattatcatcgaaccttctggtgttggaaaattgtcagatgtaattaaagctgttagtgatgtacatagtcatgaattagaacttgataattatattgctgttatcgatgctaaaaaatgtcgattatacacaaagaattttggagagttttttaataatcaaatcgagtacgcctcacttattattttaagccgaactcaagatataacagaatttcagctagatgagtgtttaaaaattattaaagaacataataatcaagctaatgtcattacaaccccatgggatcagcttaccaaagaaatactaattaatgcctttagtaatagtgataatcttcgtgatgaattgttggaacaattagatatttgtcctatatgtgcccatcatcatgatcatcaccacgatcatgaacatcatcatgatcacgaacatcatcataatcacgaacatcatcatgatcataattgtgagtgtggtcatgagcaccatcatgctgatgaagttttcaccagttggggtaaacagacacctaaaaaatattctaaatctcaattagaaaaaatcttaaaagaactaagtgacagttccgcctatggaaatattttaagagctaaaggatatgtcgatagtattgaaggtgattggtggtattttgatttagtccctggagaatatgaaattcgtataggaaaacctgactttacaggtcgaatttgtgtcattggcgaaaaattagataaaataaaattagatagattattcgatgaggtcgcttaatggaaacaagagtatatattttcgcaggctttctagatagtggtaaaacctcatttattaatgatactttaatgaatcctgatttttatagtgaagaagacaccttattaattagttttgaagaaggtgaagttgcctataatgatatttatttaaaaaaatctaatacttcattggtaacattagattttgaaaattttaccacctatgatctaaaacatttagaattagaatatcgtcctactcaaatcatgattgaagctaatggaatgatggacctgaatatttttgtaaaagaaacgattcctgaaaactggaaagtggtccaagtattaacaacttttgatactactactttttcaatgtatttaaataatatgcgttctcttgtatatagtcaggttgtctttagtgatcttgttatttttaatcgctacgatccaaatattagaaaatccatgttaagaaataatattaaagcgattaacagtaatgctcaaatcatttatgaattagctaacggcactatagatacaatgaatcctgaagaagaattaccatttgatattaataaagaacatttagatatacaagatcatgattttggaatcttttgtatggacgctatggatcatcctgataaatataatggtaaaacagtcaaaattaaaggtaagtttatcggtctagatcgtgtcattgaagatggttttgtcctagggcgtcaagctatggtatgctgtgaagaagatacctcattgattgggcttgtctgtattagtaagctagcaaataaattgattcctgaagaatggatcgttgttgaaggaaaaattacagttgattatgatccggaatatcaaatgaatgttcctatattaacagtggagcacctcgatgtagtccctccattaaaaaaccaatatgtgacatttgattaaaaataaagatgcctgctttattataaaaaagcagacatctttattattttccaagtttttcaactatttgaactactaattcttgaccattcatctgaccataaacgaatggatcaattacttcgatcggtttttctggcaataattccttaactcgatacaaatcatgttttatttgaggagcaataaaaatataatcagcatatttccccaattcattaatttttaagattggataagcatatacttcataattatacccctcttgactaatataccttttcatacaattaactaaaatacttgttgaaactccctgtgcacaaaagatatatatccgcttcattattcagcctgcaaattattttcttcatcaagacatttcttatcgtatactttgatgaatggataccaaataaggccagatacaatgaacattacaacaaagataagcaccgcacgccaatctaaagtacacaagtattggaaaaacggcatcggaatattagaactagcagcaattacagctttacccataatgccaaaattcatacagcaccaaattattcccatattgattgtgtaaaaagcaatccatggaattcctaaaattggattaaacataattggagctccatattgaattggttccgcaatattaaaaattgctggaacaatcgatattttccccattgatcttaatcgctcacttttacattttaagaataatagaggaattatgtaacaaaatactccagacatttggaacattggtaaagtgaatatttttgtagcagtttctccggctgcataagcagcagcattagcacctgtattggcaatcaataacggaagaattattccagatacaacattaaacccatgtactcccaagaattgtaaaaatgcaataataaatgccatcaacatacagaaccataatgattcagaaccttgaatcgccggtgttaataaactcattatccaagatggtaatagcatccctgtgaaattttgacaaagtaaagataatccatagaaaccagcaacgatcaagcacatcggaataatcgcatcaaatgaagcagctactgctggaggaacactatcaggtaatttaatttgaatattacgtctctttagtaattgcatgatttccacggttaccaaagcaacaaaaattgctaaaaagattccttgtgatcctagataagttgcatccatattattatcaacaattggtgctgccaaaacaataaatgataacagcgatacaatcggcgcttgtaataaatcaagtttatatgttcgtgcatggtaataagcgatagcgcatactgcaatgactccaaataaaccgaaaaccatattatacgggaataaaattgcatcctttatcgtctcactataactaggtatgaatggaaatatatctggtaatgctgaaataagctggaaaatactcccaaaaatcgttaatggcattattgccattaatccaaaactaatcgattgcaaatgcctttgtgttgctaacttattgcccacttcaataagtttatcttgtaattttttcattttattttcctcctatatatttgctgcaataaaatacgcatcattagttgctccaactacttgtcctaacttttcacaatcaccaaacatcatcgtttcatcagctattccatacaatttaaaagcttcctcacgatttggtttcattccaacagcaattatggcattatcacatttaataatagattcgccatttttatttattattttaactccgctttcactaaatcctaagcattgactatttattaaaatggtcaactgtttttcaaatcgttttaacaaacgccttaatcctgctcgatataaaatatgcccttgactagctatttggtcagtcatttctattactgttactaattttccacgttctaataactctactgctaactctattccaacttgtcctccgccgacaatacaaacattatcttttaaagaatccaatttaggataaacgttttcaaaataatcaacatattctaattgttcccctgggaaatggaggcgaattggtgaagctccaatggcaacaagcaccacatcaccatttagttgctctaataaatttttagtagcggtcgttttatacataacttgaatatctcgcttgttaatttggttttctagataatctcgatatgcttttaattcctgtttatgcatttcatgttgggccaaatttaattgtccccccaatttatcacgttgttcaatcaaaataacttgatgtccccgatcatgtgcagttattgcagctttacaaccagcaggaccaccaccaacgacaatcacttttttaataatctcacttttttctaactttaatggtacccgatgttcccgacgatatcgagggtttacagagcattgtacatttgtatgttctgtagcactatgatagcattgtaaacagcgaatacatggtacaatatcatcgctttgcccctgcattgcctttcgtggtaaaaatggatctgcgactagaggtctacccattgaaataatatcaactacaccttcttgtaataattgctcagcttcttttggcgtcattattgaaccaattacaccgactagtttattaggaaagttttgtttaactaattttgcccaatgaacattagttagatgcggttcaaaaatactttgacaatgtttcccattaacactataccaagcttccaatcctaattcaggctctattatttgatcttctggaaaatatcctggaatcatatccatcccagctgatacattgatcaaatcaacatcatcttcgattctttttaataattccaacatttcttcaaattggtaagacccttttaaataatcactcgctcctaacaatataacaattggaaagtctgtgccaacagcattacgaatcgttttaacgtgctctattgtaaagcgcatacgattttctagcgaacccccatattcatctgttcttttattaaatactggagataaaaactgggttgttaattcttcatatccaacgtacaaatagataaaatcaaaaccaaatcgtttgattgccaatgcatcatttcttgcctgtttcataatttcctgaatatcttcaagcgttaattcaactgcacgagcgccacttcttgttaaatatggtgatggtgctaaaacctgcttaccatcataatgagctcgaatatcattagctgcatcttgttttagtcgtggtacacaccaagttccaaccttagccccatactgacgggctactgaaatagattcacgaataccatcgcgatcatgttttggaaattcaccattgtcattagccgcagattcaattgatacaaaagtcattgctgctccacctacagacttatctataatactaacatttccatagtgagtcgtagataataattcatggctcttgggaatccccatcgttgatgcaataattctatttttcaacatcattgtattaactcttaatggttgaaataaatatggataatactgattcattttccaactcctccttgctctcttattgtatgtcaaatagcttttgcatccaaaccagcttttgccacgatcatggcaaaagctgaatcacaattttaagatttctatcaagaagtttgttataatatgataaaggagtgattattttgcttgaacttacctctagacaatttttaattattcgtctattacaaaaaaataccgttccactaagtgctaatacgctatcaagattactagatattagtcctagaacacttagaaacgatatttttcaaattaataaaaatattgaggattttcatatttcttcatccaaaaatggctatcaattaactttattaagcgaaaatgcccatatgcttataaatgatattaaaatatccgaacaatcaaagtctactaatataattttacaatatctgcttaatcacccatcatgtcacttattagagttatcagaaaattgttatatgagtgaatccagtgttgctcgctgtattaaaacaatcaaaccgcttttaaacaaatatcatctaacagttgaacgaaaaaatgatattttttcgttacatggtagtgaatatgataaaagagctctttttgctcatttaattgggattgaagcttcacaaccaataactagcctacaacactttcaacagtattttcaagattttcatctttctgaaatagaagctataatcgactctgttttaaagaaatataatattcgagttgacgatattcactatcaaaatcttgtgatgaatacatctatcacgcttcaaagaatttttgttggaagcgacatcgaacccctgccgttttcatactccttatctaatgacgaaattatttgccagctgtccaaagacctatgtcataacctagaagaatattttaatcttcattttgctcaaacagataatgaatatatgcaagtcctttgtattggctcgattaaaataaacgaagaaaattatgaaacccaaattttatataatgattatagttttgtttataaaattaaagaaattctcgatgatcttgttgaacacttttcattgcaacttaattatcaaatgtctttaaatcattttgctttacatattcatcgtttattttttagaaatcattcttcgctttactttcaaaatgacttccataataaccttaaaaatacccatcctttcatttatgagttagctgtttattttgcctataaatttcaagaaagtttcaatattacagtgaatattaacgaaattggcctattggcaattcatttaggtttaatgattcaatccaatgaagaaaataaacaatatttaaaagcactatgtatttgtccagagtataatgatttacgaaagcattttgccaatcaatttttattaaactttggtgataatgtacaattaattagttttatttcttctaaaaagaatattcaagactatcattttgattttttgatttctactattaatgactatgaaagccccgattgtatggtaatcagccccttgctattatcacaagatattgataaattgaatcttaaaatcaatctattaaaagagaaaaagaaaaaagatctgctaaaaaaggaattatctaaatacattgatcctaaactcttttttagaaatgttgattttacatgtaaaaaggatgctattttatttttatgcagtcaaatgttaaaacatggtgatgctaaaacagattttgttgatagtgtatttgaacgcgaaaaaatatcaacaacttcattttttaataaatttgcagttcctcatgcaattcattttggtgatgtaaaaacccgaattacttttttattgaatgacaaagcaattccttggggtgatacctccgttcatttagtcatgcttatttcaataaatgaaaaagacataatgactttcaatacaatctattcttcaattattgatcttttattagatgatgagtcttttgatgaaatgttgaaaatcaaaacatttgatgaattatcagtttatttagaaaatcatgtttaaaaaagttgtaatgctttattcattacaactttttaatctttatgcaaagatatttcatttattaaaatattatgttcccgatgatttgaatccacaaaattaactgtaccattttcattcaacttagtaaatgtaactaaaccataatcttgaaattcaacctgtttatcctttaaataagcaatatcattagcataatcaagaattttatcatacgaaccttgctgataaagactatagtatatcttaaaatatgttaacattgctatcattagtgatttaacttgatatgtctggccagttttcatcttcattgaagcataatcaccgtttattgaattaacatttaatccaactccaactacaaccccttctaaatcagtttgatagattgcctctactaagattccacaaatctttaaatcatcaacataaatatcattgggccacttaattttagcttttattccataacgatctagtaaccccgccacactacaagcaactagctgtgtcattttatgaaggtcttgaggttttttaaaatcttttaccaaaatactcatcagcaagtcatcaccattcttactttgccaaacgtgtccattccgaccccgaccatttgtttgataattacaacgaactacacttagattaggaagtttatttaaattacgttttacgtaatcatttgtagaatcgacttcgtctaattcaatataactcataatatcaccccattactatacttctattatattagaaatttaggaaaacaacaaatatttattataaagttttattctaatgcaccctttactttttttctagtgaaacaacgatcttgacgattagctaaagcgctaacccgggcttctagcagtatttttctaccactttcattacgagtataaataacctgataattaccaataaacggcttcatatagccagcaaatatatgcgcatcttcttttcttttagcaaaactatcaggaattgcaaaataacaatctaatttattttttcgtttaggattataaagaatataacgttgattatcaatagatgcaaaaaattcattgatgcatttggcaaacaaagccttatcatgccctgttccccctaataaatatattgcatgtatcgcattaaaagaatctgtttcaacgcgactattcaaagaatccagctgattggttttttctaacgcatttctaattcctttgccaaatatttctaaacgacctaaaggatttgctaatgtataaagttttttgatgctcaaaagaatactcataacaaatattccaacataaattatcaccactagatattctaaaatatctatcaaggtcaatgattttagaaatggtattccaatgacagcaccaataatcccactaaaaacaattatcaataaagttcttaaagcatccataaacataacgacagttataaattcttctttaacttcagtttcttcaacaatttcaattttgtcatagacagctaacgaatcttcccatcttttctttaattgactacgctttgaagatagtttaagcatatctttattaattttttttatatttcctggactaaatggcaatttaattgcgctaagtcgcaagattccattttcaattatatcctgctgataatgcaaccctaaaaaatgttccattctccttgcaagcgtttgaaaatcttcactaccgccatcatcataatgacccgttaacttttcttttggtctaacacaaactaaatgccaaatattacttgttttattgggcgttttctcaaaaactctaatagctcgtccacgcatttgattacttaacatatatgagcctacaaagctagccaaaataagcgaattaacacacggtgaatcccaaccttctccaagtaaagatttagttcctatcaaaacttgcatataaccctgcgcaaatacctcactgattacccctgttataaaattacggtttccactaatttcaacttttacataatcatctaattttccaatttgatggaagctgattttactaggttcttcaactaattctattaatgctgtttgagcatccttggggataataatcattgtgccacataaaacaccaaatttaattgctgtcttatttttagcactatcacgccttagttgttcaaaaaatggtaaaacgcctaaattattcacatctttgctttcatcacctaatgcccgttcgtattcttttcgaatataatcagtaagaatcaaaagtcgtaattcttgtttcatcgttttatattcataattaacaatttctttaatgctttcacatttaccaaccgaatttattagcattttttcaattgcttgatttaaacacaaagaaacttttcgtttttcgattaaacctttagacttcaattcacgaatcaattcatcacggtattgttcttcaactcgatatgaagcaatatcatcatataaaaagccttgcagtaaaatttctaaccatttaagtgataagggttctaacgatttatatcctaaaagcttttgatacttattcgcactgcacactcccttagtatttaaaaaaattatcattgctgataaatagctcggatcatctaatagctcatcatcacttacttcctcagtaaaaaagcgatgactcataatagccttacaaaaatattcatcttgtattagctgctccaaaatactttgactattttcctcaaagatacttaatttttgtttttcttgagaggccggataattgaaataaacataatcttgatgtggacataaagtaccatctttaactaattctggaactgttatctcttcatcaatatcaccacacatatccatatacctagtccacatgcttagattagaatcatatggcggagttgctgttagagccactgtgaaaatattattaaatgcttttttaaattcttctaatgatttccaccactcacttcgaagatgatgacattcatctagacataaagttcctaattggcattctttaaaattactgattacatcaaaattatgataatcaacttcttcaactgttttaaattcatcattagtctctactagttcaccacaataatgactcatcgcactatgtagtgcctgatatgtcacgacagtaattaattttggtttttttaaatcttgagaaagatattgatcgcgattttcttgtttaactaaaaaagcttcacaaatacgctctacccattgttcacgaatcgttattgatgggactaagattaaagccgagtaatcgattctttttattaattcaattcccaaagttgtttttcctgaaccaggtgcagcaacaatatgaattttacgatcttgactataaccgtcatatttatcaagaacacgttgttgataactgcgccaagtgcccttgaaatgcaaaatttgttctaacatccaatccctcctattacctttatttatacatatcaaccttaaaacatcaatacaaatcaacttaattttatgataaaaattctccttccactaaaaaagtagtacaataataatcaaaggtggtgtaattatgacgatgtatattcaaacccaaaatcaatatacccaattccaaagtgatgagttaactgatttacttggtaagattagttttactatcaataaatttggactttggcaaagtaatcacgatactagagcaaattatattactgatgatattgaaattgtctattatcgagaaggtgggtctattacaaccattggcaataaaaaatacacctgcccaccccacagctttctcatcatcgaaccctataagctcaacacttcaataaatactggaaatactaactacagctattatttttttcattttgatattgaacccctatcattgcgccaacaatttattactctcttaacaaaacacgggcatttaatatataaagaagaaataaaagacttcaaagaaatgctagaacgtttattaatcgaagctagtgaaaaagaaattggctattcaagcattataacctctgctttgattcgagttgttgtagagataatccgcgctcagcttaaaaggaataatgaccatatttcacaaataacagatttaccacatatcgaattagttaatgatgccattaagtatattcatgaccatcttcatgaaccaattaaactaaccgcaatggctttacaactaggtgtttcaacaagtatgttatataaatcttttattgcaattttagcaattcctccactaacttatattcatcaacaaaaagttctctatgctcaaagaatgctggctcatggtaaaagtgttacaatgattgcaaatgacctgggatattcatcagcctatcatctatctaaaacttttaaacaaatcacaggggtcagtccacgtgaatataagaaaaatattaagttattataagcatatacgaaaatgtatatgttttttaattgatataatatgttttatatatatgtaagtgctatcatatctttataagggaggtatgaatttggaaaataaatatcaaaaactctttcaaccaataaaaattaatcagttggaagtaaaaaatcgaatttttatgtcgccaatgtcaacaaactttgcaacaaaagatgggtatgttactgatgaaatgatctattactatagcagaagagcaaaaggtggcgttggtctgattgtaactgaagtaacaatgattgagccaacctacaaatatattgctcatactttatcaattcaagatgattcctatcttgaaggatggcaaaaattagctaatgaaattcataagtatgatagtaaggtcgtagcccaactactgcacccagcatatatggcaattcctttcccggaaacaccacaattagttggtccaagtgaggttggtccatactatgctaaaactcctccgcgacctttgacaaaagaagaaatcagtataattgttgaacaatttggtgatggtgccttacggttaaaaaaagcaggaatagatggtgttgaaattcatgctgcacacgcacatgcattactaggaggatttttatctccactctataataaacgaattgatgaatacggtggtgacataactcatcgcattcgtctacttttagaagtaattgcaaatgttcgaaaaaaatgtgggcgtgatttcgttattattgttcgtatcagcggtgatgattatgaagccggcggacaatcattacacgaaggatgttatattgctaaaagattagaagctgctcaagttgatatgatccatgtttctgggggaactactatccaccgcggcagctcaattgcaccccctggaacaccacaagcgagtcatattgacagcgcacgagaaataaaaaaatgtgttaatatccctgtttcaaccgtaggacgtttgaatgaaccttggattctcgaagaagttttagaaagagatttagcagacgtatgtatggtaggtcgctcactcttatgtgatcctgattttgttaataagatcaaaaatggtcaagaagatgatattcgtccatgtattggatgcttgggatgtttaagctcgaccatgttaaaagatcatgttgaatgtggaattaatccatcattgacaagtgagaatgaggaaactgtaacacctgcgacaatatcccaaaatatcctagttatcggaggaggtccagctggattagaggcagcttatattttatcaaagcgtggacacaaagttacccttgctgaacgtcatcatacattaggcggcgcaatgatcgttgcaggttatcctattgctaaacagtactttgctcaaactactaaatatttcattaaacgagtgatcgattgtaatatcaaaatcgaattaaacacgattgttgatcaagcctatttatcacagcatcattatgatcatatcatcgtcgcaaccggagccaaaccattacgacttgatatttttaaaaatcatcctcatactggtaccggacaagatgtgcttcttggcaaaatgtggacaggtaaaaatattgtcgttgttggaggaggctctgttggctgtgaagttgctgattttgttgccccattagttaatgaccgccatccaaataataaaaaagtaactgttattgaaatgaaatcaaatattattatggatgatacttcaccatcacgaagtattttagttcaacggatggctgataaaggcgtgaacattattactgatagtaaagtcgttaaagttacaccaacaactctcgaatatcaaaaagatggcaatactattacaattgaaaatgttgatacaatcattgaagctactggttattatgctgatcatgagttaaaaaaaaccctcgatcaaatgcaacttagctacaacgttttaggtgacgctgcaaccccaggaaaaattaaaaatgctataagtgacgcatatcatttatgtaaaaatatttaatcaaaggagaaaatatatgaatttactaaaacctattaaagttggaaaaattactttaaaaaaccgaattatgtttcccccaatgacaaccgggtatgaagaaagagatggttcaatcggtgaacaaagttttaatttctataaacgtttagcgcaaggcgatgttgcttatattgttttaggtgatgttgctccagtcaatactgtttcccctacacctaaactttttcatgacggtcaaatcgaagctttcaaaaaattaagcgatgccttacatgagtatgattgcaaactagggattcaaatctttcatcctgaatatgatgttgatgctctagcagaattatttagaaaaggtgatatgcaggctgcacgtgctaaattacatcatgacatgctacattatatcgatgaagtaactgaagcccagcttacagcaattattgataaaatcggcgcttgtgttaagcgtgctgccgccgcgggggtggatattattgaggttcatggtgatcgtcttgtcggttccctttgctcaaccattctaaatcaccgaaatgataattatggtggttcatttgaaaaccgtattcgctttgctctcgaagttgtcaaagtaattaaagaaaatgctccagatatttgcatcgattataaactgccaattatcactgaaaatccgcttcgtggtaaaggaggcctaaaaattgatgaagctattaaattggctactatcttagaggctcatggagttgatatgatccatgttggtcaagccaatcatactggaaatatgaatgataccattcctgcaatgggaactcaaccatactgttttatgaataaatatacaaaacaaattaaagatgttgttacgattccagtgtcttctgttggacgaatccttactccccaaaatggtgaatccttgattgataacgggatttgtgacattattggtttaggtcgttcattattagctgatcctgattatgttaaaaaattaaaaaataatgaagctgctcgaattcgtcattgtatgatgtgtaataaaggctgtaccgatgcaatccaaaatagacaatttttaagctgtgttttaaatgctgaaaatggttatgaatacaaacgaataattaccccagcagcaacaaagaaaaaaattgtagttgttggagggggaccagcaggtttagaagctgctcgggtagcaaaaacaaaaggacatgatgttattttatttgaacaagacactagattaggtggtcaacttaatattgcagcgattccaccacgtaaagctgaaatgaatcgggctatcaattacttatcaaatgaaatgaaaatattgaatgttgatttaagattaggtaaaaaagcaactagtacagatatattaaacgaacatcctgatagtgttatcatcgctgttggtgccaataatgcttccctaccaattcctggcagtgatttaactcatgtgttagatgcttggaaagttcttaactatgaacaattccctagtggccatgtagcgattattggcggtggtctagtcggagcggaaactgcagaatttttagcacaaatgggcttggacgttactgtcatagaaatgcttgaagaaattgcaaaagaagaatcatcaactgtaaagccagtaatgtttgaagattttgaaaaacatcaagttaaattattgactaaaacaaaggtaattgaaattaaaaacgattgtatcaaagctgctaatggcgatggtgaattaacgattccatgtgattatgttattttagctactggagctaaacctaatccatttgatgtcagtgaattaacagctcacaatattgatattcatcttgttggtgactgcaatgaaaaagctgctgatattaataatgccattactcaaggttatttagcagccaacagtatttaaaactcttattatctagactaaaaagaattaatcataacatttaaatgtttaagattaattcttttttattcttattaactatctactattactagccattctaaaccacgtataattttttcctttgattgatactgataattgataaatattttctggccaagtacatccgccaaagcctccatccccgatagcatgaatatcacatccggtttgtttcattaaaagggcaacctgccgaattgtatcctcatcggcacattcgaccgaactatttaaaaaactcatggctaaagtacctggtttatagcgatgaatatattctactaattctctaatcatatctactgtgattcctgctctagtccctggagctggtaaatcgatacagtcagcaccagcatcaataagtcttttaataacatctttggtatcatatgctgctaaaggatcacctagtaccttttcttcgataccatcttcccacttgccagcaaacaagaaaatatcatctccacatatttcttttactaatttggttgcttcaattacatcttcaatcgatgttccagaacctggattaccacccaatacaataaaatccactcctaaagcaactgcttttaaaatatgttcttttgttgctaacattccagccaatcggtaaagtgttttttcatcagaacgcttttctcccttcttaggacaccctaaataaacaccaattgaacaattgcatttttctttaagctctttgatagttaagccgcacaatcctggattattttcaaaattatctaaatctatagtattaagcataaccatatctgcaccaaacgaacaaagcaattcagcatttgtcacacccattaccgtccctgggccagcaaaaattaaatgttgtcccatgataactcgaccttccgatttatagatagattcttttaattctaaaggacccattttgtttatctcactctttgaagcattaatcaatctttttacgttgctcataatttttcctcatttctagattttgttttcttcaagtgttttttcttgattactttttttctctgcttctaaagcctgattgtcacaaatcttaaaaaatgggtaataaattatacatgataacaagcacataattacaatcatgattcctaaactaattcccccacctaaaataaatcccgcaattggacctggaattgtcattacacttaacattaaggcgggaatattcacaacacctgtaaccatcaacaaataaccaataatcataaatacaagtggtgttaaaataaacggaataaacataattggatttaatacgattggaaaaccaaaaataacaggctctacgatattaaacatccccggaacaaaacacacttttccaaacgctttaaaacgttcgcttttagcaaatattgccatatcgcaagtaagcccaaataaacatcctggtccaccaataaactgacaaaaaacaaagaaaaacatataagttgtgactaaggttacaggttctccggccatataattatttaaatttgtaattgctggttccatccaaattaccatcatgacagaaagtacaactgaagtaccatgaattccaacccaccataacagcaataatattaacatactaatcaacatggctggaaaactattacctaaacttactaaaggcgcttgaaccatagtataaataaaattttgaatatttccataagatgttacagcaaatccagaccttaccaataaaaacaaggctgatactaaaaatgctggaacaacagcttcaaatggtttagaaaccatttccggtaccgaatctggtaattttattttccaattatgattaacggcaaaagcaaaaacatatgccccaataatcccacataacatggcagtgaagataccactagcacctaagttatcaactgggataacattttttatcaatgttacagctccatttgtactatcaacattgttataagaaaatggtgtaaccaacaatagtgataataacgaaacaattgctgtttgaaatggattaacattaaacttttcacctaaattataacctaaagcaaaaatgaaatataatgctgttaaattacaaacagcaacccctacagctaaagcatcagatattccagtagacgataaaaaatttgtataccagtctcccaatggtaaaccctgaaataatgaaaatacagctcctcctaataacgctggcatcactttcataaatgcgccacttattgcacttaaaataaaattgttttcaattttctgtgcaaaaggtataactttattttggataaaatcattcataatttttcctcctcctaactttataactacattttatctagaagtataatcatttaagagtacataaaacttttcattagtccaaaataaaaaccaataaaaaaaataagtgctaaggtttcattttttgaaacttcaatacttatccttggttatttaatcttgctaataagctttcaataatcttcattaattcaaatttcttcttaatccctggctgttcgtgtatctctaaaaaacgtttatgagtatacgagctctttaaagatatgatataattattttcgtcatttaaatgtctataaatattcctgatcaaagcattggatatattataatcatagtatttttctaaacttatctgaagatgactataaaaatataacgtatgttcatccatattaatagctaaattgttatcttcttcattaattatataaatatcataacctaatacataaaaatatttcaaatacattttccaaatcaacattgcttctcgctcaccaaataaaataatttgatgacaatgattacatgctataactaaatcatcaagtttatcacgatcatcgagcaaataaataaaatcacaaatcacagcattaaattctcttacaaaagtctttttaaaatccgtgaaatgactagtttttatacttttacaaaatctaatgattgatgatttagatagaccggtatcataaataacatcctctaaagatagttctattagcttttccctttggtttaaaaaatatttaacaagaatttgatccgtattattaatttttgcattcattgataaatctaaaagtatatcgatcattttatcactgctcctgataaataatctcgtgataataaaatttaatcaaatcaaaataatacaacaacaaatactcagtctcaaacatttcattattagataatatattaattacctcaaaaacattgtaatgaaaatttatttttgtttcgcctgaaaaaataataactttattagctttatttcctaaaatcgacactaaattatcatcagataaaaaaagtctaccagtacctgaaatcaatataattaaatcattatcctctatttcaatagaattatcttttaataaagacgacattatcactgtcttccccattgaaatcatatcaatttgaaaattaaaaagaattggagttatcgtaggggaagcaacaataataactctctgactttgagctatttctttaatgatcaactttaatttcattttatcattgaattctaatggataatcaactaaatgtgaaaccgctacagctaatcgttttttgttaaaaatcttataacctcgatatatctgatctttacgaacatccaattcactttctaatctttctttaaaaatcgaataattagaataaccaaatttttttaaaaactgttttactgttggaactgaaacaaaacagccatcagccacatcttgtaaagtaatacttcctatatgattaatattttctataatatatttggcaatataataatttaaatctttattattagagttattaacaattgataaaaaataagctaagcacataaacatattatcttcctccactcattattaccattatataatattaattaaatttattcatttaaaaattagctttcttgtaccagcaaaaagctccaatcaaatttgcatcattataataatgacacactttgatctctggtggagttaccggaactgggatgcaatcaaataaatcactcacttctttctttaacattgttaataataacggctgagtactaatccctccaccaatactaatattctctaaatctaataacatttgcatattaaaaatatatcttgcaagatttttagtataatcccgtagtatttctaaactagcaatatcattatgattagccttgttaaaaaaggctaatccatcgatcgaatttcgctctaatgcaaatcgtttttcataatttctcgttaaataacctacaccgccaatcaatccaaatgtattttgccaatcaaagtcatgtttagaatcaattaaagaaaacgtagctgctccagcaaaataattacacccacgatataattccccgttaataataattgcgcatccaactccagtacccaatactagtactgccccattactcgtttcttttaatgagcctctatacaattctgctaatgccgcacaattaccatcattttcaatcgaaactggtacgtggcatttactccaaaggatttgtttaatatttttattatcattaaatctataactaccaccattttttattaaacctgtaaagggattcatttctccacaataactaatcgcaattccggataatttcatgtgtatagttttaaataaatccactacccaggtaatcatttcatcatgactttgaaatattttattttctttatttacatcatataactgaaagttttcatcaataattgcatatttaactccggtgccaccaaaatctaaacataaatatttcattatttaatccctcatttcttaacactttaaagttatcatagttaaaaaaaatataaatactatataatttttggttgtgtcaaaaaatgaaacatagaaatctaatatgaactgttagctatgattattgtattgcagcaaataaatctttatctttgttaatatcttcttgaatgacttttttgatatataaagctaacatatatggcattttttcttcaaatgtatctaactggcaatttaataattccttgactttagtcattctataattaatcgtatttcggtgcatatataaatttttggccatcgctacttgactgccatcatgaatcaagtaatagaacaatgtcttttctaattcactatgatgtttttgatcataatctattaaaggctttaataaatgctgatacattcctgataaaatttgtttatcctcgattgaaaataagatttgataaactcccatctcttcaaaaagaatcatcggatatttaaattgttctgccattgcaactgcagctcgagctcgtttataacttaagattacttgtctaaaatctgtcattggcgttccaatacctaagtgaataaatcttgaaggcattcgcttctttgttcttttatacattttatcagtaattttctctaatgaatccggatctaaattatttacaattaatacaaaatatccatcaaaccaaaaaaatgtatatgggctttgtattttttcaaaacataattccaattgaaaagaaactctacgtcgttcaattgcatcaaactgatcagaatcttcaattccaattaaaacaacttgaaaaaaaccatccacatcaaatgcacctaacaattgctgccgaacctcctcaacaacttgaggagttgtaaaaacattctgaaataattttgaaatctgattgtcttctcgttgtgaatataaacagcgcatactaaaatccttaattaaatctgccatgtgtacttcccagggtgtcgttaacagcggaaaatcctgctcattacaatagtcaattatatcttgaggaatttcaaatatatatttacctgtattgataactaatccaacactatggtatttaaccaaacacttgataaaatcaaataacgaatcgtgactttgaaatcctaaacctgttgtaactgccaattcttttccccataattgttgaataattgtcgtatcctcaatcatgtgaacccaactcatcgcatttgaacagccctcacgaccagctaacaattttaaatgatattgctcttgagtttgtactaacgcatcttcaatcgtaaatcccattttactcacttcctttatatttattttaccattatttgtgcatgatgcacaaataaatcttatttttttattatttctgtctctataattattaaaatattaatatataatataattgtattaaaaatagaacatctaggagggacataacatgaacatttcttatggatattacgtactaactgacaactttgatacttgcccaacttgggttcgtgatgaaggatatttcaattgtgaaaacttttcaaaattctttaagttttttaaaaagaaataaataataatgagcattcataacgaatgctctttttcttttaagatttaaattatgctattagataattattttatatttaaagcagcttcataaccttctttaactgctggtaaagcattacctgccttaattgcgccacctactacttgaacatcttcacataattcatttgcaattttttctaacggattataggctttatatccaaatgctaagacaactaagtcagcagaaataacttctttttctctctgttcattaataaatgccactccatcatctaaaatttctgtcacagtacaattagctctggcagttactcttgattcattcataattggtaatagacagctcatattaatgggatccatatcagtcaaaacagctggtttcatttctagaactgttacatgacgatgcgtttgagcaataaatgtggcagtttcacaaccaacttcgccccctccgcaaacaacgatatgctcaacttttgtagcgatttttcctaataacacatcttcagcattgactacattttctttatcgatacctttgattgccggcaccagcggtcttgctccagtagccaaaataatagcatccgggttttcttgttcaatcatctcttttgttactaaagtatttaaatgtacttttacatgcagatcctctaaattctttttaaatacagatattaatgttgttaattctcctttaccaattggataagctgcagatctaaattgaccgccaacttcttcctgagcctcataaacagttacattgtgacctatcattgccgcagtttcagccgcctgcagaccagcaggtccccctccaacaatcattactttttttgctttttctacaatgtccattgaattttcatattcacgtcctacccgtggattaactaagcaagtgacttcttgattaaaaaataatggcatttcacatccttgtagacacccgatacacattttaatattcccatatttttctgcctttgctttattaggtaaatctggatcagtcaatgaaccacgccccattccaataaaatcagctttatccatgttaattaatgtatctgccatttgcggatcgttaattcgattagttacaattactggtaaatcaaccaatttctttacttgtgctgatatctccatattcaatgcatgttccgtaaacattggagcaattactgctctatttccaggtgaagcataagagccattagaaatatgaataccatcaaaacctaattcttcaaaaatcgtacataattcataagtttctgcttcagttcttccaccatgaacatattcattaccagaaagacggacgataattggaaaatcatcaccaacttgttttctcatttctaaataaatttcagcaactattcgtactctattctgtagacaaccaccatagttatcaactcgcttattgacaaatggtgataaaaactccgctaataaataaccatgggcacagtgtagctcaattccatcaaaaccagcttctttagcacgtttagcagcactaccaaaatcttttactaattgattgatttcagcaactgtgatatctcttggttgttcttgacataagggacattcaattgctgagggagcaactggcatatgatcttcattagcaattctagtagtttgtctacctggatgatacatttgacaaaagatttttgattcatacttatgaaccatcgttgttaattgtttatttccttcaatcaattcatctttatataaaccgggaattctttgatatcctttaccatattgttgaactgcataatcctcagtaataatcaaaccccagccgcctttagccttttcttcaatatatttcatataacgctcagtaattttaccttcaatcgtacaataatttgtcaccattgccggaactactaaacgattaggaatttttacagttcctatttgataaggggtaaataatttttttaaagccattttaatatcctccaatccttttataactttattttacagtatcaaatgatttgaaggtcaactctaatttattatatgtgatattattcacatattcttttttaatcacatatattttactaaaacaacataaaaaactctcaagctatttgagagttttttataatcggaatttgtatttctaaataccgtttaaaatgatcaccttcatatccacgccccctaataatcccccgtattggtaactgtacatgataacctttatcttgagcatacattactgctgcttcataacactcatgactaaactgtcctaacggtcccatttctattaccgtgcataaacaataatgagccggaataattgtatacttctttttataagaaatacttaatccattaaaatattcctcatcaatagcaaaataccattcatctttatctttattaaaacaaacataactatcaataaaattaatatatttatcatttaataaaaatcgaatattatcttcactagtattaactttatcataatcatcaccaattccatctacaaaatcaaaagcatattttttattaattttctttacccaataatttgataaatttaaatcagctacctccagttgcattgccaactctgtgactcgttttttcaacatgactttataatcaatctctttatttagtcgcctttggaaaatatgtaactgattttgaagcttttctctataattaaaattaataaaattaggaatttcttttattttcattcctaaattctgatactgtaaacattctaataaaatatatatgtcaaaaatactataatagcgatacccattcttttcatctcttataggatcaataattcccattttttcataatatctaatcatttcacttgataaattaaacaatcgtgaaatatcccctattttatactggctattcataatatcagctcctttacaaataattttatcacttaatcttcctatttaaaaaataattttattattagtttttataaatcaactattggtagatttataaattaattaaaactcgttataatcaaaatataaaggagaaatcaatagatggattgtattaaaattggaaaatttattgcgacatgctgtaaagaaaaaacttaacccagattgaaaaactaaatgtaacaaataaagctatatcaaaatggtcgaaattttatcgatgcttcattttatcacgattttcgcgatatcttaggcattactattaacgaattattagctggtgaacatctcaatactcaagataatcaatattactatgaaatgaatcttcacaatcgtattaacagttacaataacataaatcgaaaaaataaaataattattttcatgatttttagtacattgattttttagtcattacgtatttacaaataaaaactatatggatttttatcatggattcaatacatctaaaaatcattatttagaaaagcaaattcttgatctatttcattctttatcagtccctggcaacacacatccaaactttgatgaactttattatcggaaaatatttgaacagtctgatagtagtaaaatgtactatatttataccataaatactaagcaatattattttattgaaaatatattctaaacaaaataaaaggtatcacgaattatatgggagagggtccgtgataccttatatgactattatagcatatttaaaaaaataagcatttaatctgattaaactttaattagtttctccaaaagaaatctagatttcaagtattttagtctaaatatattatacttttaatctctattacaaagatttagaaatctttatcaaatcaactaaaacaaatctattctacatttcagttagagcattgttttttataataaatcatttttacaagtcatatacctaactaaccactataccaataattactttaataatatttcaagaaattgatacttaaaatattaatattcaatttcttcaagtgcatttttcaattgattcaaagcttgtcttaaatatgctcttgggcaagcaatgttaattctttgaaacccttttccttcttttccaaacatcgttccactatctagccataatcgagcatgttcaatcaataaatcatttaattctttatctgaaatttgtaatcttctaaaatcaagccaaagcaaataagttccctccgggataatcaactttatcaatggtatgtgttctttcaaatattcatctacaaaccgtgtattttcaaataaatattgctttaaatcttcaagccagcttgaacacgattcataagctgtctggcaagctgctaatccaaacaaattacactggctataaccagtactggcaatagcttttttaaattgtaatctcaatttttcatcggcaataaaaatatttgaaatttgtaatccggccaaattaaaagttttagtaggagccgtacaggttattgtaatattctgtaattctgtctttaatgatgcaaaaacatgatgctgatgccccggataaataaaatcactatggatttcatcactaataattttaacatcatttttaaggcagatttgccctaattttaatagctcatcttttttccaaactcgaccaactggattatgtggcgaacataaaataaacaattttactttttctttcttaatcttctcttcaaaatcatcaaagtctatttcataatgagcgttttttaaaactaaagaatttgttataacacgtcttccgttatcaataattacttctttaaaaagataatatactggtgtttgaataattactccatcacccaatttagtaaatgcccgcactgcttgtgctaaagcaaatacaacaccaggcgtcttaactatccattccttttttatttcgtaattaaattttgaccgataccaactataaatagcttgataataaccatccttactatcactatatccataaataccatgatttaccacatcatataatcgttgttgtatttctggagcaacgataaaatccatatctgccacccataacggtaaaatatcatctggacgttctctttcactagtgaaatcatactttaaggagtttgtattagtacggtttattattgaatcaaaattagatttcatcattatcaccaaaagcctgcctcaaatcagctaataaatcatcaatattttctattcctactgataatcgcaaaaaattatctgtaattcctaatttagctctaatttctgctggaacatcaccatgggtttgaatcattggataagtaatcaatgactccacacctccaagactttctgcataagtaattaattgtacattttctaaaatcttttttgctaaaaaatgattttcaacactaaaggctatcatgctgccaaagccgcgggcttgatttctattgatttcatatcctggatgctctattaaaccaggataataaactttgctaacccgcggatgccgatttaaccagtttgaaattttcagcgcattttcttgttgtgatttttgtctgattgccagcgtcttgatcccccgaatcaataaataacaatctagtggtgacaagctatttccaactgtctttgaaacttctctaatccttttagctagtttatgatcaccagtcgaaatacttccagcaataatatcattatgcccacttagaaacttagtagcactatgaattacaatatcagcacctaataataatggattttgaaaatatggtgaaaggaaggtattatcaacaattagtaacagcttgtgggcttgacacaaggcactaattttttttaaatcacttatttgcattgttgggttactcggcgtttcaataaaaacagcttttgtttgaggacgaatatactgcttaaaactctttaaattagttgtatcaacataactgaattttaaacctttattttgctgcaaagtaaatagtcgagttgaaccgccatataaatcatttgaacatatcaaatgatcaccactactaaaaagttctagtatcaatgaaattgctgccattccactagaacaagcaactgtatcaactgcgccctctaaattggaaataatctcttctaaataagctcttgttggattactttcacgagagtagttataccctctgctttccccaatcccaggatgagaaaaaattgctgtttggtatattggaattgaaacagcaccataaggatgctgtttcaattctaaatttgcaggatgaatacaacgagtttcaaattcatatttcatacttttctccatttccccacgctaagcgcatggacacaaatatttcttgaaagacattctgattccttctactctactaccccctgctataatgaaagggaggtagtatactacagagcacgagaagtagagtaggtaattctactcgttagaatatcttgtataattataagtcgccgtcatcttttcgagcacaaataattaggactcagagcctggacacttattattgatatattaccaatttggtcatattgctagatgacagtcagtaccacttctcctttctttgaaaggaggttttattttatgaagattgttcgtaaaatatgttgtggcatggatattcataaaagtcttattgtagcggccatcgctgcttctggtgataataatgtcacgacctatattcaaaagcagttttctacttttaactctgatttgttgaatcttttaaactggcttaaatcaaacaactgttttgatgtttgcatggaatctaccagtaagtactggattcctgtctttaatatccttgaatctgaactcaatatttttcttactcatcccaaatacgtgaaggtgattagaagtaagaaaaccgataagaaagattcaaaatggattgctaacatctttaaacaagatcttctcaagtactcttttattccacctaaaaacattagagaacttagaaaaatatcacattatcgcattaaacttgtcaataagcgctcttctgaacgcaatcgttatcaaaactgtatgactgtttctaatattgccttagcttctgtctctactgatcatttaggaaagaattgtaaagctgccatggatgagattctcaaaagtgatattatcactgaagacaatcttaagaaaattttcaagggttctgtttcaaagaaatctgatcaaatttttcaagccattcagaattctcacattgaatctgaccaaagattcaaaatcaactgcactataaaacacatgaataatcttgacgaatatattcaaaactggttagtatttgaaaccacttcttgttcaatgtgctctttcggctatcaagagtgaaaaagaaacatatttcagaatcaagtataatcgtattaagaaacgacgtggtcataagaaagctattatagcgaccgctagaatgattcttatttctatataccatatgacaaaaactggtgaaaacttcaatccatctgattatgaatcattaaaaaatccaaaaccaggcaaccagaagataaccactcatcaagcattagaattattgaaatccatggatattgatataagccaaatcaatttattttctattcaacaaacgagttcatcatgaatttttaattttttaagttggctttttttataaatttctttcacacttatccccttttaattatagctaggtacataccataaaccattattatttttatctaaatattctttaaattcttttgaacgataagcttcaacaattgctttagcccattttgtatctttatttttttcttttacaactacttgtaacaataaatgttctaaaacatcctcctgtaataacgcactcgaagcatcaattcctgcattataaactatgctgccggtgattacagcataatcaaactcatctaaagcttgaggaatcattgttgaatccatttctgtaaactctatttcataaggatttttaataatatcatcttttgtcacggaactaatatccacatctggatctaaagtaatatactttgctttttgtaataaaacatatgctctagatgtatttgaagcatcgtttggtacagcaatcttagcgccctttttaatttcctctaagcttttatgagtatttgagaaaattcctgcaggtacagttggaattgctgtcaaagctactaaatcaccatcttgtgattcattaaaatttttcatgtaagctgtatgctgctcaacattgacatctatctcgccttcatttaaggctgtatcattttgcaataaatctgaaaattcgatgcatttaaattgataaccttcttttttcaaaattggaataatggcatcttcaaataagactgtatatggccccgctgccttaccatagataattgttgtcctatcttcacttttatcactactactttggcatccggccaaaacaaaaaccaacactaataataaactcaatattctctttttcatttttcttcccctattcatgtgttctaatttttttagataaatgatttcccaatgtttgaattaattgtacaaagataattaaaatgattacggtaacaaacattagagtattattaaaacgctgataaccataagttaatgctaaatcaccaacaccaccgccgccgattgttccagccatagcagttgcccccaataaaccaatcgttccagtagtaagtgctaaaactaacgaagctttcgcctctggtaataaaaaataacgaatgatttccaaagtatttgcccccattgctttagcagcttctaaaattcccggttgaacttctaatatagaactttctatcaaacgagccaaatatggtgcaatataaaatactaatggaacaattgcagcctttgttcctattcttgttccaaccagcacttttgttagcggagcaataaatactaataagattacaaatggcacagatctaacaatatttactaacccactcacaagaaaatgaattgtatgattggctttaactccattttttctagtaaggactaaaagtaagcctagcggtattcctatcaaggttccaaaaaataatgatattcccaacatataaattgtctggcctgccgcttcaagtaatttatcagcaggtatatttaaataattttcaatcataattcaattccaccctctctatcttcacatcttgtttttgaatataatttatcgctcgaataacttcatcctgttcaccttttaactgaattgttaaaattcctaaaatctcttctcctacttcattaactgaagcaaataaaattgttgttgtaattttaaaatgcttattaattttagaaattacatcatgctttgtactttcaccaaaaaaagtaagttttaaaaccggataccgataatctaattcttttaaaagtgtggttggaattacattgctaataactgtttcaacaaatctctttgtcatttcttgttgtggattactaaaaacctctaaagtatcacctttctcaatgattttaccagatttcattaccgctactttattacaaattttcttgattacattcatctcatgagttattaacaaaattgttatcccaagttcacaattaatttttttaagcagcaataaaattgcttctgttgtctgtggatctaaagcactagttgcctcatcacagagtaaaatcttaggttctgtagctaatgctctagcaataccaattctttgtttttgacccccagacagttgtgatacataagtatcacgcttatcttccaattccacaaaagataataattgtttaactcttacttcaatagcttttttatccagttttgaaagaatcaatgggatagcaatgttttgatagactgtttgtgattctaataaattaaactgttgaaaaatcatacctatatcttttcgtaaaatatttaattctcgttcttttaaatctataatattttgattattaatatagattgccccattttcaggacgttccaataaatttaccattcgtaataacgttgatttaccagccccagaataaccgattacaccgtaaatatcacccgcttctacttctagagagacatcttgcaatgctggaacttcaccacttttagttgtaaaagtcttatttacgtgttcaattttaatcattctcatctgcctccaattttaaaagagcctgtttcgccaattggctaagatattttgcagctaacgataaagctgcaggatttaccttaaacttcggatgatgattaggataggtctttccggttccgattttaataaatgttcccctgattttttcaagataaaatgcaaaatcttcgcctcctaaagttgcttcgggtatccctatagcaattttttctgcttgagcaattgctttagcaaaattactccattcttcatcattgacggttgcaggaggccccgctatccactcaatttctgtatcaagatcataggcttggctaatcccataagttatttcctttaatcgttttccaaacagctccctctcctcgctagtcagcgttctaacagtcccttcaattaaggcttgttcaggaataacattccacgtattccctgcttgaagatgtgtaatacttaaaacactactattaaaaggatccatatttcgactaacgatcgtttgtaagctgttaactaatgcagcagctgcaacgattggatctttagccatttgtggatgggctgcatggcttccaaagcccttcaaattaattttaaatcgatcaacagcagctgaaattgtccccgctttaattccaattgttcccacttcaaactgcgaagtactatgaattccaaaaattgcattaacatcatctaaaacccctgtctcaataatttttagagctcctaatgaagactcttcagccggttgaaataataattttactgttccatgtaattgagcagcattttcatttaacaataaagcaacaccataaatcgttgttaaatgaaaatcatgaccacaagcatgcatctttccttcaatctctgacttatagcttaatgtcgtttcctcattaactggtaaagcatcaatatcacttcgtaaagcaattactttaccagggtatccacctctaataactgcaactaatccagtttttaatggtaaatctaaaacttcaatatcatgctcttgtaataatgttttaattcttttagtagtttcatattcctcataagataattccggattacgatgaaaccactcaaattgatattctaattctttttgtaaactgtcgtcttccattctaattccccctttttaataacaaaagtgggatgtttatgtaaacatcccactaccccatttaatatagtattaagaatatttgcatacacgaaaatgtaccctatacttttgtatacagctgcacatacacatatacatcatatctcttctgctttttaacatcatcgttcgctcctcttcttttcctactatatcgataggtttgctatgtaaagtatcttaacacactataaatactccgtcaagcaaaaaaataaatgtcaatatgtttgcataaaaaaaatagctaattagctattcttcgttgatataaataaactcctaaagcagcaccaataataatgatatatccaactatgctccatatatcaggaatttgatttaagaaaataaatcctaatatcgctgcaaataatatttgactataatcatagattgaaatatccttgccagctgcattattatacgccgcagtaattgcaaattgaccaccagctgccattaaccctgcacctagtaagattaaaaactgttctaaactcatcggctgataattaattattaaatatggtaacacactgagacaagaaaagcatgaaaagaaaaatacaatttttgcaccatttaccccctgcttgcctagcttccgcacacaagtataagctattcctgctcctaatgcccccaaaacaccaataattgaatccacattatttaaaagattaaaagatggtttgattacaaacaagcttccaatgaaagctacgataattgatattttttgtattcttgtcgctttttcttttaaaaacaaagaggaacaaataattacaaaaaatggtgataatttattaagcatcgaagcatcactaactaaaagatgatcaactgcataaaaattacaaagaattcccaacgttccaaagactgagcgtaataaaagcatcggtaaatctttttgtttatatgtaaatccctgtttactttttaataggataaaaaaagcaaataaagcagctaccaaatttctaaaaaaacttttttgaattgatggtaaatcgccagctaattttacaaatacattcattgctgcaaaaaagaaagcggctaaaattatacacatcatccctttacggatattattcataagcacctccagatactataatgattatatctattataaccattacgtcaattaatatgatttacaacaaaaaaggataactttcgttatccaattaattattattgaacagcaaatataagttcagctttacaaactaccttaccatttaccttagcaacagcatcaccaattccaattggtcctttttgtttagttagagtacattccatttctaaaacatcaccaggcgttacttgacctttaaacttacacttattaatgcccccaaagaaagcaattttacctttattttcttctttagaaagaattgcaatacacccaacttgagctaatgcctcaacaatcaatactcctggcataacatgatgctcaggaaaatgaccacaaaaatgcatttcattaacactgacacatttaattccttttgcccactgtccaggctggtaatcagtaattcgatctactaaagcaaaaggataacggtgcggattgatttcttgaatttgattactatttagttccattttcttattctccatatttcttaaagatgatagtcgcattatgaccaccaaatcctaatgaatttgacatagctacattaacatcttgatttctaccagtatttggaacgatatctaaatcacataatggatctggtttttgataattaatcgtagctggaataaatccctcttcgattgctttaacacaaattaccccctcgattcccccggcagcacctaaacaatgccccgtatttcctttcgtcgaagaaatagcaacctttttagcagcttcacctaaagcagatttaattgccattgtttcacctttatcatttaaaggggtactagttccatgtgcattaatataagttacgtcttcagctactaaaccagcatccttgattgcattgatcatcgctttagccccaccagagccatcttctaaaggtgcagtaatatgatgagcatcacaactgacaccatatccgaccatttcacaatagatatgagcgccacgagctttagcatgttccaattcttcaagtacaacaattccagcaccctcacccataacaaatccacaacgttcctcgtcaaaaggaattgacgcccgtttcggatcattattatcacaaagagctttcattgatgaaaagcctccaataccaagtggagtaatactagcttctgccccaccagcaaccataatttcttgataaccatcacggatatttctaaacgcatcaccaatcgcattagttccaccagcgcaagctgtgaccggacaagtacataatccttttgcccctaattcaattgcaatatttcccgctgccaaatttgtaattgacattggcacaaagaatggcgaaacacgatcataacctttttctaaccccttagtatgatctttctcaattgttgcaagccctccaattccgcttgacacaactacaccaaaacggtcagcatcaatctcttcaatctttaaaccagcatccttaaaagcctctttagcagcaattacaccaaattgagtaaagcgatccatttttcgaactgcttttttatctaaataatcagcagcattaaaattttttacttcacctgcaatttttacttttgttaattctttatcatagtttgtgatctcgtcaattccacaaacaccttctttaatacttttccaagtttcttcaacattatgaccaattgcattaattgctccaagccctgttactacaactcttcttctttccattgtctctctccttacattgccattccgccatcaacatggatagtttgaccagtaatgtatctagcatcatcacttgctaaaaatactaccgtattagcgatatcacttacttgtccaaaagttcctaaaggaatttgtttagccatactttctttaatatcttcaggtaaaacatcagtcattgcagtttgaataaaacctggtgctaccgcattcacagtaattccccgactaccaacttcgcgcgctaatgacattgtcattccaataattccagctttacttgctgaataatttacttgaccagcatttcccattaccccaactactgatgacattgaaataatacgaccataacgttgtttcatcataattttagtcgcatgtttcatacaattccatgttccttttaaattaacatcaataactgcatcaaaatcattctctttcattcgcatcaacaatccatctttagtaattccagcattatttacaagaacatcgattcgaccaaattctttaatgatttctttaaacattgtttctgtttcttcaaatgaagcaacattagcttgagctaacataacagtcgcaccgattgcttctaattctgatttagttgcttcagcaatttttttattatcaccaaaattaacataatttacaatgatcttagcaccttcacgagcacaagttaaacaaatttctttaccaattccttgggctccaccagttactaaaactactttatcttttaatttcatcttattctccttttaatcccgctaatgttttttctaatgatgcttgatcttcaacttgataagttttaattgtcttatcaatcttacgaataaatccacttaaaactttaccaggaccgatttcaataattgtatcaaccccgttttctaacatataacgaatactatcttcaaaatatactgaagacattacttgcttctctaacatttgagcaatactaactccagactcaagttctttagccgaactattgaatattacaggaacttgcatttcattaaaattaacacttacaaacttttctttaagttcattactagctggtgctaataattctgtatggaaaggtccacttgtatttaaaggaattgcccgacgagcacctttttctaatgctaattcgctagccttagtaactgcctcagcctcaccaccaattactaattgtcctggacaattatagttagcaattgaaacaactcccaaagccctagcttctttaactgcttcatttaataattcacgatctaagccaataattgcaatcattttgctttcaattcctgctgccgctctttccatcgcttgaccacggaaacgtactaaattaattgctgtttgatcatctaaaacacctgctgcatttaaagctgaatattcaccaagacttaatcctgctacataatctggagcaattccattttcttttaatagcttagttgctactacagcaacagcaaccatacatggttgtgtatttcttgttaaagaaagttcttcaaggggaccttcaaagcataatttctttacatcaatatctaagtcaatgttatcaaaaacatctttagcaatttgatagttatcatagaatgattgacccattccaactacctgactaccttgaccagcatatacaaatccaatcttacccattattttagtcctctctttaattcatccattaattcttttactgaaataattttatcattacgatatccattgcttccactaaatactaatccctcatccaaattacctttagcagcattgatcaatgcaccactaatacaataaggcgtagttttaacatcacaaggaattaagcaattatagcagcgttttactggaatcctttcatcttgtttaagtctttttgtcaacttcgtcatgatggctcttcccggcattccaactggtgatttaacaatctcgatatctccttttttagcatttataaatgcttgtttatatttaatatctgcatcacattcctcagtacaaataaaccgtgttgccatttgaacaccatcagcacctaaatctaaatacttttgaatatcctcactatcataaacaccaccagctacaaaaataggaatatccttttgatatttttcaacaaatggttgaacagtctcttttacttctttaaaaatatctactaatttagccgttgttttatttaacacatcttctttatgaaagcctagatgaccaccagcttcacttccttcaatgacaacaaagtctggagctaccttaaatttacgatcccaagttttacaaatcaatttagcggctttaccacttgatacaattggggcaattttaacttttgttccttgaacaaaacttggtaagttcataggtaatccagcacccgaaataattgcatctattttactttttacagctacttcaactaaagctgcatagtcagtaattgcgaccattgcattaattgcaaccatccctttacctttagcaatctctttagctttctttatttcattagctagctcacgtttattagcttctagcggatttttttcaaaatcatcagcacgataaccaggatgagcagttgaaataacacccataccaccatttaaagcaacatttccagccaaatttccaagtgaaataccaactcccatgccaccttgtatgattggtacatcaagagtcatatctccgatatttacctttttcataattaaaactcgctttctaatttcttaaatgccttatcacaatcatcaaataattctttaataattacttttagaggtctaatttcattgatcattccgactacttggccagccattaatgaaccggtatcggcgtcaccttctaaaactgctctacgtagtgaacctaatgtatatttttcaagttccatcatgtcagcaccttctttttcacgcttaacatactctttagccattttattttttattacccgtactggtgttcctgcgattcttccagttactgtagtgcttgtatctttagctttgattacagcttgtttataattttcatgaatcggacactcttcgcttgcaagcagacaagttcctacctgtactccacaagcccctagagcatacgctgccaatacctgttttccactcgcaattccaccagctgctataacaggaacactaactgcttcaactacttgaggtactaatgccattgtagttaattcacctatatgaccacctgcctcagttccttcaacaataattgcatcaacgttatatttttcaaggcgctttgctaaagctacacttggaacaactggcaatactttaattcctgctgctttccatgcagcaacatatttaccaggatttcctgctccagttgttacgaccggcactttttcatcaattactaattgtgccatctcatcagcacaaggattaatcaacatgatattgacaccaaaaggtttatcagttaaattacggcaaatttcaatattcttttttaatgtagcagtgtccattccaccggcaccaattaaaccaagtgcgccagcattagatacactagctgcaaattcaccggtagcgatatttgccattcctccttgaatcaaaggatattcaatatttaataatttatttaatttcatcttctaactccattccattaatgttgcgccccaagtaagaccaccaccaaaaccaacacaaataattttgtcacctggccttaacattcctttttcattcatttcacctaaagccaaaggaatgctagctgctgatgtattcccatattcttgcaaattcatataaaacttatcttctgaagacttcatcttcttatatacatttttaataattcgataatttgcttgatgacagacaacgtaatcaatctcatcaagagttaaatttgttttttctaagattgcattaatactttcaggaattacttttattgcaaacttaaacacttcctgcccagccatcgttaaataatgatcctgattagatttactgattgccggggcctttaatgcttctaaatttcccgctgaattactgtagctagcaaaaataccatcaccatttccaactacaagggctccagccccatcaccaaacaaaacacaagtattgcgatctttgaaatccattattttggaaatttcttcacttccaatgactaaagcatatttctcttccatgttttgtaataatgcctgggctaccgttaaggcatacacaaagccgctacaagcagcatttaaatcaaagcacattacttcttgatcattcaaacctaatctttcttgaatcaaacaagcagtgctgggagtaaaataatcgggtgtcattgttgcacagataatcaatccaatcttacttttatctattttttcaactgcctttaaagctgcttgatacccaagttctacgcaactttcattttcagcaatatgtcttctttttatcccggttctagagacgatccactcatctgatgtttcaaccactttttcaaggtcgaaattatcaagtactttttgtggtgcataataaccagttgataatatttttaatccactcatataatctcctaatatttttctttgatatcttcaaagaaatacaataactgttgtaatgatttaatcaataactcatcatcaagaacatgactatcttcacagacgcgacttaccatctcttcatgaaagtctcgatgtactttgcaaacacgattgcctttagctgtcagctctacacgaataatgcgtcgatcattatcatctttacgacgttttacgtatcccttagcttcgagcttttttattgctgtcgtaattgttccattagttaaagtcgcctgagaagcaattgttgacatcgtgggatttgaaagcgaactgattgcatcgataatatgcagttctgataaacttaaatcttccactccatgtcctaccatatattgggtttcaatatccaaaatttgattaaacagtcttacaaacagttgattaattaattctcgatttaaaatatcgcgattagtcattcgtaattcgacccatttctctaaatttattgtaacgtttatttactaatgatgtttttgataatttcatcaattcttcaagagtatttcgaagatagattcttaaacgtttgtatacatattcgcggttctttgtaattccacctcgaggttctttgatgatcttatcaatgatcttcatttcatataaatcatttgcagtcaatttcattagctctgcagcttcatgaactcttgaaccatctttatctttccataagattgatgcaaagccttctggtgataaaaccgaataaacactattttcaagcattaccatacgatctccaacacttagtgccaaagctccaccactgccgccttcaccgattacaatcacaataataggcaccgtcagctgtgacatttccattagattacgcgcaattgcttcaccgattccatgtttttcagcttttaaacccggataagcacctggtgtatctacaaatgtaacaattggtcgattaaatttttccgcctgtttcatcaaacgcatcgctttacgatacccttctggtgaagacattccaaaattacagtgtagattttcctctaaagttcgtccttttaaatgtccaattacagtacagggaatattattaaacattgctaatccaccgacaattgaaccatcatctttgtaaagacggtccccatgtaattcaataaaatcatcaaataaattatcaatatattcacggacattaggacggtcagctttacgagcaagataaactcgatcataagcactaatatcctgatatgcttcagcttcaatttttgcttttgtattttctaaatcttgaatttgtaaagtgtggtcaatctcttggtcatcctttaattttaataactctaattctatttctttaatttttatttctttttcttgcagcgacattattgcgcccccctgctatgcatttttaataatttgataatcgtttcacgcattttagaacgttctacgatcatatcaataaatccttgatcttgcataaactcggttctttgaaaaccttcgggtaatttttgtttaattgttgattcaattactcttggtcccgcaaatccgattaatgctttaggttccccaataataatgtccccaagcatggcaaaagaagcagtaactccaccagtagtaggatgagtaatatacgaaatatataacaatccggcttcatgatgtttggctagagcagcactagttttagccatttgcattagtgaaataattccctcttgcattctagctcccccagaagttgtaaaaataatgattggacatttgcgttttgtcgcatgttcaattgctctagtaatcttttctccgacagcacctgacatactccccattaaaaaacgagaatccatcacacaaacaacaacttttcttccatcaattcttcctgtagcacaaacaaccgcttcgtcaagatttgttgtttcttctaattttactaatttttctttataaccaggaaacattaatggatcatttgatttaatacttttatataattctttatattttcccccatcatacaaaagatttaatcgcgtgtatgcccgcatctttaaatgtgctccacatttaggacaaacataataactttctttcaaatcttcacttaaaatcgactctccgcaagaatcacactttgtatataaaccatcgggtacatcaattctttttttatcttgcattttattacgaatagatttaaataaattcaatttttcttttcgtgccttaaataactcttccatttattatcccaccaacttatctaagttattttcaataaaacttgtatcaaaatttccttttacatactctcccgtatgtaaaatcaaatattgtaattcttggttagtatcaattccgtcaataactaattcagctaaaactctacgcattcttctaattgcttctaagcgattagaaccatgaacaataactttagcaatcatggaatcataatgtgatgaaactttatacccctgatataaagttgtatcaattctcacccctaaacctcctggtaaatgaacactattaacagttcccggacacggtctgaatccctcacgtggattttcagcattgattcggcattcaatcgcatgtccatttaaatgaatatcactttgtttataagttaatttttgatttgcagcaattctaatctgttccctaattaaatctaccccggtcaccatttcagtaattggatgctcaacttgaattcgagtattcatttcaataaaataataatttccatcttgatctaaaacatattcaatcgttcctgcattgcgataacctgctcctttagccgctttaactgcatcttcccccattttttgtcggagcagcggtgttaaggctttacttggtgcctcttcaatcatcttctgattgcgtcgttgaatagaacaatcgcgttctcctaaatgaataacatttccataattatcggctaaaatttgaaattcaatatgtttaggatttaaaattaatttttctaaatacatatcatcatcaccaaaacatgctttagcttctgctttagcagttaaataagcatcatcaaattcttcttcgctaaaggcttttcgcattccacgaccaccaccacctgctgaggctttaattaaaactggataaccaatttgatttgcaacttctttagcttcttgtaaagtatttacacttccatcactcccaggaactaccggcacacctgcttcaatcattttttgacgggccatacttttatttcccatcatatcaataacatcgccactaggcccaataaaagttattccacattcttctactaaacgagcaaaagttgagttttctgataaaaagccaaatcctggatgaattgcatcacaacctagtgcagtcgctacacttaaaatatttttcatatttaaataactatctgctgccttggcaggacctatacataccgcatgatcagccaattgcacatgcaatgaagtactatcaacatttgaataaacagcaactgcttcaattcctaattcttggcatgttcgaattattcttaccgcgatttcgccacggttggcaattaaaattcgcttaaacatcttaactacccttcaatgatcattaacacttgatcaaattcaactaaatcttcagtatttgccatgattgatgttactgttccatcaattggagctttaatttcattcattaccttcattgcttcaacaatacacaacacctgtcctgcttttactttagtgcctacttctacatacggtttagcagttggtgaactagatgcataataaaccccaacaattggtgatttaaccggtgttccggtgattgctggttcattagctgctacttgctccactggcgctaaagtaggcgttggagcagaaactaccggtgtacttacaacatttaccggtgctactggcgttttttctaattctaatttaatatcatctatctctactttcattttaaaaacttctgagttttcaaattcatttataagttgctttactaaatctattttcataaatactctcctttattttgaatatcaaagtaattttttaaaaaaattattacccagctattctgggtaataaaaatcagcatttattatgcattttctttgatataatctacgatatcttgaactgttttaatttcagctgctttatcatcagggatttcaatatcaaattcttcttcaactgccatgattaattcaactgcatctaatgaatctgcatctaagtcttcttttaagttagcttctaaagttactgcatcttcatcacagcttaaagaatcaacaattatttcttttactttttcaaattccacgttatattcctcctcgtgtatattacggtcacattataacaaaatcaaaacatttgtaaatagtttgatgttcaaaacttttatcgaagactgtcgaattaacccaaaacctagtaaaatcaaggtgtttcaagtaatattttttttcgttttttttatgttttaatcgtcatttttttatgttatagtcttttttaggagggcacaattaatgaaaatacccgaaataaaagctaagacaatcattcaaaacaaagccgataaaaatcatttttggtttggttttgactacaacatgaatctctaccaaggatgtcatcacggttgtatttattgtgacagtcgtagtgattgttatcaaatctcaaactttgatcaaattaaagtaaaacataacgtactcaccctactttctaaagaactttgttctaaaaaaagaaaaggggtgattgcaattggagccatgtctgatccctataatcattatgaacaacaattaaagataactcatcaagctttaaaaataataaagcaaaccaattttggtgtaatgataacgactaaaagtcatacgctcattaacgatcttgaactcataaaacaaattaatgataaacaatctgtcctaatttgtatgaccattacttgtggtgatgattcattagcaaaattgatcgaaccaaatgtttcaatttcatcaaaacgatttgaaacaattaaacaattacgccaacacaatatttatgctggggttttaatgacaccgattttgccatttattaacgatacccctgaaaatattcgagaaatcatctatcgcgcacatttagctaatgccagctttgtttatcctatgtttggtgtgactttacgagatcatcaacgtgattatttctatacgcagctagatcatttatttcccggctgtaaggaacgctatataaaacaattcggtaatacttatttatgcaacagcccacgactttatgaattaaaaaatatatttattgaagaatgtcacaaatataatatcatttataagatggaagatattataaatggttataaacaaactgcatcatcggaacaattgagtttattttaaaaaatagtccagaagatcttctggactatttagcatgttcatatgtataattcattaccacttaatagataatactcatctttttttagtatcaatgttttgatagtctaaacgtttatacaaattatcaatatattggtgttttaaaacctcttgaaaactatatttaaaattcaaatcaaatacaaatactaaatgtggtaaccaaatatctaaatcattttgccgacagctgcttaaaatcatttcatgattcaaaaatgactggtacactgctctcactaatcaattgtttttctatttcttcttttcccttataataaattgtttctagcgggagagtagattaatttccagcttatcgattttgttagcatcacggataatctttgcatgcagtaattcatgagtatctaatcccattcaaatcacatatttattgtgctttttgattgctttataaataatttgctcattattataaatatcactaaatttttcaatcaacctatcttaaaataataaagagacatcgaaatcatattcactgacataagtattaaattctttatatgcatcctctatttttatcattaacttacctcaaaaaagtgatcttaattattaagatcactcttttcttttaaatattcattagcatggttcattatatttaacatcttcttaaaagtatcactattttgataattaagtcgtttaactaattttgtaatataatcttgttgataaacataattacaactatactgataattcaaatcaaatatcaaggccaaaaaggatacccagcgatccaagtcagttttacgagtggtactaagaattgattcactattcataaatgtttcatatatcgattcagtaatgatgtcattctctaaaatctcttgtccagcatccaaaaatgcttcgaacgtttctaacaaacctgttttaaagatatcgattttgtcagcatcacgaattattttacagtggagcatctcatgttcacttaatccctcagcaattttatatttattatgattaaaaatagctttgtagatcagtggataatctttttgatcaatatcaaatttactaattaaattatcatcaaataaaatttgaacacctaataatgcatgatcaattgttttactatcaataaaacaattataacgttttaattgttcaaatctcccaatatcatgtaataatccaattaatgatgctaagtctatttcatcttgatctaacccgagactcactgcaacattttttgaggcctccataacacgataagtatgttctatctttaaggcaactttaggattatctttatcataattcgctacatattcatcaaacaatcttttagcattttttaaatctatcatctaaccacctccagctatcattatatgctctttaacagcatttctctactattttctaaatagtaatttctatttttatatggttatgttatattaataaacaaggatgtgattagatgaaattaagattaactactactaatgatttaaccgctgtcatgacaattatcaatcaagctaaagtatattttaaagagcagggaatcaaccaatggcaagatggttatcctgatgaattaactattattaatgatattagccgccatgaagcttatgtgcttgaagataacggagaaatagtcgcaactgcgatgatctctaaagagcttgaacctagttataattatatagaagggaaatggcttcaagataatgcatacattgtagttcatcgcatcgcgatacgaaatgatcaaaaaggtaaaggcttggcaaaaatcattattgatgaaggattaaaactttatcctaaaaaaccaagtatccgtatggatactcatgatgataatctttcgatgcagcgtttcttgattaaatatggatttgaatattgtggcactatttatttagaaaataaagaaactcgacgagcatatgaaaaaattctttaacctgcattacaaagtgcaggttttattgttcaataaaatcaatcaatacttgattaaaacgttctcgttcatcataaaaaatcccatgtccactatattcaaacttgcataaaatcgaatcttctatacattcatgcatgattaaagcaaatgaaaaaggacaaattttatcaagcactccatgcatgatcaaagtagtgaccttaatctcaaacaaatcttgatacacatcttcatctcgtaaagaaattgctgtttggatcgttcctattcctgatccctttaaacaaattgatgtaaaccagttcataaattcactgccatgatttaatgcaaaaacattttgtccgaaatcatgaaccattttaggtcgattagtataacactgctcaatcagttgatttaccgcatcgatactttgtccttcgggattatgaattgtacgagtatatgaaggcactgcagcaccagccaaaactagtttacttactcgttcttttccaaatttactcatataacgaacacaaatcgccccacccattgaaaatcctactaatgtcacattatggacatttaaggttattaaaacactatgcagatctatcgctaattggtcataacataatcatagcccctgcccatgacttgtgacattcctaatccacgaatatcataactaatgatgcggtatcgacaatcgtttaaaatatctttttgatattcatacatttcttggcaaattggccagccatgcactaaaactactgtcttttgatgagctggattaatatcctctaccgctaatttggcattatctgatgattttagataaaacacataatcccccctcatcatattctatgtaagctcaataatattataaccttattttaattattaatttttgtataccagcagtcgattaagttaatcaatatttactatgattcgctatcattaattttgataaattatattgtgatattggagtgagaatattaatatatatcatcagtgcaattattatctatgggtatagttgttattattttaccagtactatcgctaatcttttaattgcattaatagccttatgagtatttggtatatttatcatcggattaattttcttaaggaatgtccgcataaaaaataattatagtggtctcttgtaagttgaaacattccttattctcagcttgtttttaaatgattttaatagcttgagcgactataaccccattattctttttactaacagaaatattactatgacatataatatttctgttagtaacttgataattacaataattttgactattatcttagttattttcaatatttatatctttaagtgtaaaaattatttcatttgtattcatatcttattgtattcagcatatttttatatgaggtgaagaacatggatactaaagtaaataagccttaccccgaaataaaagtaactgtgccaaatgaaacttatggtttaatgatccttgataatgtcggtgggatgaattctgaaacatctgcaatttgtcaatatatttataaccatagtattgctggcgaagattttttagaactaaaaaaaacatttttaaatatttctatggtcgagatgcatcatttagacatcttcatgacccttgccttagaattaggtttagacccccgctggtggagctgtctaaatgatcaatgtacttattggtcaccatcatatttaaattatcctaattcactagaggaagtactaaaaacagcaatagacgctgaatatcaggcaattgataagtatatgtatcaagctagcgtcatcaaagatccctatattgttgcgattttaaatcgaatcattgaagatgaagaactgcatatcaaggttttaaaagaatgggaaactaaattagttagataatctaactaattagttttccttcttttaataattgcaataattgtaaattttgcgccgcactacctacataattagtaattccattaagttttgctaaatgttgacgattttcaaaacttgtatcaacattaatttgctgaagggctccaactaaactatctccaacataattaggatttgataaatagcttaccctaccttcaattacctggtcattgacccagccttgatcattacctattaaataaggatttcgagtattttttacaattcgagttatctttccaacattacgatatggccgtaacggattagaagattcactagttaaaaagacatagctaaatcttactgtatcacctaatttatattgttccactgctgtatcaatatcaaaattattcttacctgcacgtttaataatagctggaaaatcagcataacaataattcatatcaacaattgttggtaccccttgaacccatccagtcgaactatattgccacatatcatacggtttatcataatttaactcagcagcatagttagcaacccaccgtgtataattatcaaaaatcggatccgttaatttagtgttccaccagtatagtgaagcgtacatcccaacataatatccattggcttctaattcatcagcaaatgttttagcgatatttgcaatcacatcatttgattgctttccagtcgtattattatcttctaaatcataatacactggatatgccatcttatagtttttcactagacgtaaaacatgttgtgcttcccctctagcatcactactatttttagcatatgaatataagtaaacaccaaacggtattcctaatcgtgtacactcgtctgcatttcttttaaacaaacgatcatcttgatctgttcgatcttgaccaaaaccacatctaagaattgcaaaatcaactcgatcttgaacaatttcccaatcaattaccccctgatattgtgagacatcaattccatgtgtcgtcattcttccacctccattaataatatatgagcaattgtcaaaaatgtgtgactttctagacttttttatcattttaatgcgaaacaatgaatattatgttataatcacattggtatggattaaatacgccatctttaaaactgaatataaaactaaataatatatataaattggaggtcgatgaaatgaaaaaagtattcgtcactgccttaggagtctgtacaatgctttcattagtaactattcccactcctgttcaggcaactgatttttccgggcaagaagataagtacatgaaattatgctcatcttcaaatctttcaactaataacttgaacacttgtaaagaattcaatacatacttgaaaaataaaaataaagaattgaaatctcaagtaagtgattcaaaaagcaaagtatctgatactcaaaatagtttgaatagtatctcaagtgaaattagtgcattaaatgatcaaattgctgaaaaacaaaaagaaattgaatatttacaaacttcaatttcaaatttagaagcaagtatagctaaaaaagaagaagaagtaaaagaacgtatgtattcaatgcaatcatacaataacaataattcatatattgactttatcttcggggcttctagcttcactgatatgtttgcccgaattgacagcgttaatgaaataacatcgtatgatgatgaattagttgcacaactagctgatgaaaaagaacaagtagaaacacaaaaagctacggttgttactgccaaagctaatattgaaagtcaaaaatcatcaaagcaggcactacaacaagaatatcaagctctatttgaaaaacaaaacgctgatttgattgcgcaagaaaaagcagctgctcaagcggccgattcaagtcaaaaaatcactgataatatcgctgcactattagctgctactgaaaaatcacaagtttctggcggaagcgttgtttctggtgattctgcagttggaaacgcaattgcacaaaaggctttaactcgcgttggttatatgtatgtatggggtggatgtcacagcatgtctgaaatcgctaatccaaaccacactgcatttgactgctcaggtttagtcaactgggcttattatcaatcaggtgtcaacattggttctaataataccaaatcgctagctagtaaaggggtatctgtttctcgtaataacatgcaggccggagatatcatcttatttagcagtaatggaagtaccagcggaattcaccatgtcggtatttatatcggtggtggtaacatggttcatgctccacaaacaggtaaacctgttcaagtagcggatcttggttattcatattggcaaaaagaatggtatgacgttcgtagattgtattaatacaattagatgagcaagcttgctcatcttttttatcacatatatatgaaattcataaattaatttcattatttccataacaaatgtgatattttttagaaaattagctttatatccttagaaaaaatctaaattagtatttacttattaagaaaaatataggataattactatgtatcgaggtgattgtatgaaaataaaaaaagttatatctacagctttaacgctgacaatagtaacaagtgcatgttattatgcagcccctgtggcagccgatgaatttgatggtaatgaaagtaaatatatgacattatgctcatcttcgaatttatctagtagtaacaaatcaacttgtgaagcattcaacaagtatcttaaaactaaaaattctgaattaactaaaaaattggccgaacaaaaagaggctgctagtgacactaaaacaacactagaaagcgttcaaaaacaattagatgaagttaataaacaaatcagcgataaagaagctgaaattgagtatttaaatacaactattgccaatcttcaagcaagtattgaaaagaatactcaattattaaaagatcgtatgtatgcaatgcaatcttatgcaaatgaaaatacatatattaactttatttttggtgcaagcaacttcacggaaatgttctcaagaatcgacggttataacgaacttacacaaagtgataaagagttgattgaagaacttaataaacaaagaaaagaagttgaacaacaacaaactattttagaagaagctaaagccactttagttattcagcaagaagaacaaaaaacattaaaaacaaaatatacagctttgttagaggaacaaaacaaatcaattgcatctactcaaaacacgatttatgattatggtgaaatgactgaaaccctggatgctgcaattaaaaaatttaatgaagaagcatatgaaactccaactcctacaccaccgcctccaaaacctgataatggtggaaacaataataattccggtggtaacaacaacaataacaacaacaacaacaataataacaatagcgattctggaaataacaacaatggcggaaacaataataatgattctagcacatcagataatcttggtgaaaaaatctatgctgctgcttatgctaaattaggatcgcgttattggtggggagctcaaggtcccacatactttgactgttctggtttagtatattggtcattaaaacaagcaggtgttagtggtggtcgagatactgctgctggttactccagaaaatggtcagctgtaagttttgcaaactctaaaactggtgatttagtatgttttggtagtccagcttatcatattggaatcattgttgtaaacagcgatggttcaagatcaatggttcatgccggtggtggtgattcatcaacacacggtgataatccaaaagcttatgttaaagtatcttcaattgaaccaggatcatattactatagtagaataagtacaattagacgtgttagtaaataatagatattttaaaggacaaattttatagttcactacaatacttgtccttttttattttaggcgataattatccaaataatatatgatcgttatgttatatttatatcctatttaaaatttactatgctataattaaagttagaaaacaaaggagggaaatgagcatgaaagcaaagataatatccctctttcattacttattagtctttttattaataatttttaataccagctgtcaagctaaatcaataaatattgttgatacaaataataatgatcagattgaactaaatttttatggatataaaacggaagcaattaatgttgttgcaatcgaagaaattttacaagcttatatggataaaaatcccaatattaccattacctatgaaagtgtgaaaggaactgagtattatgagatactaaaaaaacgtttggcctctaataactatgatgacatttttatgatcgatgaagataatttacagcaattaactaattataattattttgaagatttatcaaagctaaaaacaataaaaaactttaacacaaactcattggaacaaatggtgcaaccagataatacgatcccctatattccaacttctatttcagcatttggattatattgcaatcttgatttactagaaaaacatcatcagtcagttcctaaaaataatcaagaatttatggctgtttgtcaatattttattgagcaaggaattactccgatcatcgctaataatgatatttctctaaaaacaattgctcttgctaaaggtctttatcccatctatcaatcacctgaaaaggatagaataatcgcttcactaaatcaagatcctagcattctttgtaattatcttaaagaaggatatcaatatgttaaacagttaatcgacaataaattcattgatgcagccacaactttaaaaacagaaaaaactgcagacgatctaatacagtttgaagaaaataaaaacccttttatgttaactggtgcctgggcctctgttcgagttgaaaaaagttcaccagatttaaattttaaagtttacccttatccaattttagacgatggagcaattctagtttcaaatattgatacccgtgtatgtattaatgctaaaggtccacatattactgaagcaaaaaaatttattgaatatttaagtcaagaagatgtgatgtggaaatttgtaaatagtcagtcctcttttagtcctctgaaagaacaacgtattgctgatgatcctaagattcaagaattaagcccttatttaacctcagagaaaacaattctaggtagtgattcaaatataaatcttcccctttggtcacttacccatgaaggaatcacccaattattaacaggaaacagtattgatagtgcattagaaataatcaaaaattatgaacagtgaggatgattccaatgaaaaataaaaaaatatcgttaatgattgtcgggggaattagtgctgtgatttttgttgttttttccatgttcatttatgttaattatgttcaagattctctttgggataagtcaatcaatgatattttagaaacaacctctcaggaggaaaaagcctttaatgtctatatgactaaagaaatgactaactcccaaaacatccttactaatattgcctatctacaaactaagattccgcagtatctccagcatctatctaatcgtgaagaagctaaatatttatatatcgactataccaatgactgctactatgatgaaaatggtaattatccgttaggtgatgaacagttgtttcagcaaataaaagctgataataattcacaaggatttttagagccctatctcaattcaaaaacaggtattaagacttttgcaacttatgtaaaaacaagcgatagtcaaagtgtcattgtcaaagaaactcaattaagttttattattgaaaacttctcactttcgttttataacgatttaggtttttcatatattgttaaagataatggtgaaattttaattcgttccaaacatcgtaactcaaatcgtacttttaaaaacttatttgatttaatcgatctgtctggtaatgatgcaaaaaccattgaatcatttaaagcatctttatctaaaagagataaaggtgttgccttatttaattatcaagatagttccaatgtattttgctatgttccattacaacaaaacaatcactggtttattatttcaattattcctaataatgtaatcatgaagcaggccaataacattattatttcctccataattttatgtagtggtattgctggtgcaatcagctgtgttgttttgctatatatccgtgataaccgtaaacacaaaagaatgttagagaacttagctttttatgatcatttgaccatgctctataattatcaaaagtttaaaacagagggggaaaaattatttttggaacgtaatcatacccttcttgcagttctgtatttagatattaatgactttaaaataattaatgaattatatggttataaatatggtgataagatcttaacgcagctggcaaatattttaaaaaaattggtcatagccccaggacttacgtgccgagtaaatgccgataattttttaatcatgcagtcatatcatgatagaaccgaactggaaaacttatgccaagaaatcaatcaaaaattttgtaatcttttagaatcacttgataataaaaataatactatagttaaaattggtatatgctgctatgaagatgatcaaacaatctcaggtattgatggtctaattgactgtagtcacctcgctttaaatgcatatatacctggccaaaccaataactattacttctataattctaaaatgcatgatcaaatgattagaaaagtagagattgaaaataacatggagtccgctttactgaataacgaatttacattctatctacaaccaaagtatgcgccaaatggacaagtcatgttaggagctgaagctctagttcgttggcttgagccatcaggaaatctcattatgcctggtgaattcattccaatctttgaacaaaatggctttattcttaaaatggatgaatatatatttgaaagtgtttgtaagtttctctatcaacgaattatcgaaaacctgccaaatgttcctatatcgattaatatttctagattacatctttatcaagatgactttattgaacgctacagtaaaataaaaaataaatatagtttacctgataaattagttgaattagaaataaccgaaaacattttacttgataatattgaaagaattagaaacattatcattgaactacaaaataatggctttacttgttcaatcgacgattttggttcaggttactcatcattaaattctttaaaagacttaccatttgaagtcataaaattagaccggcttttcttaatcaacagttatgatattcaaagaagtcaagaaatcatcaaagctattgttgaaatggctaaaactattaatattaaaacagttgctgaaggtgtcgaaaccccaagccaattggaatttttaaaaatgattgattgtgatatgatccaaggatatatcttttctaagccacgaccaatcaaagaatttgaacaactgcttataaatcaagaaaaataactttttaattagattcctatttttagagttgcagactcgaaagtaggaattttttaacattttcttagatatgcacccaaaaacagcgtattatctttatttattgagttagcaatatctcgctaaatatcatataacaattattctttccatagaaacattttttcaaaaaacgatcaataatactctttatctaataatattctaaaatttgatagtacaaagaaaacttgttttcaaaattattatcccttcattataattataaaaggtttactacatcataatatcatcaaatcaatctaataaaaaattcgttattcatatcaataccatctttttcatcaaactgtatacttttctataactataacgtcaataatttttaatatttatattaaatagtctttaaaattagcagcttttaaagaccagatattttttattttaattgaaaacgataacattgatattagagatttaataatttttattttagtgctataatctacaagaaaagagggatagtgtgaagtatgtacatcaatttttaattattatgacaatctcatttattggggaattgttgggattgttattgccattgccaataccggcaagcgtttatggtttagcaataatgctaatttgtttatttactagagtaattaaattaaatcaaatcgaggaagtagctgattggctgatcttaatcatgcccgttttatttgttccttctgctgttagtctaatcaacgttggtaatgctattattaaagatctcctagttattggaattgtcactttaattagtaccatcgttgttatgatcgttacaggaaaagttgcacaagtaatcattgaacgaaaggaggataatgataatggatagttttttgcttgaaacagtatattttgggattgttatcagtctattatcatattggattgcagttcaaataagaaaattattgccctacccaatttttaatcctttattgatcagtgctgttatttcaattggtatattaatcatttttgatattgattttgatacatataataagggagctcaattcattacttttttattgaccccagctactgtttgtttggcggtaccactttataaacaagtgcaaatattaattaaacatttagatgctattttaatcagtttatttagtggttgtcttgccggaattgtttccatttttataatgtgtttaattatgaaagccgatcctgtaatttattattcacttttaccaaaatcaattacaacagcaatcgcaattggtgtttctgataaactaggcggtaattcaaccattacagttggaatcgttattattactggtatccttggtgctatcattgctaaaagtatttgtaaattatttaaaattaagcatcctgttgcaatcggtttagcccttggtaatagtgcccatgcgattggaacatcaaaagctttagaatttggagaaattgaaggagctatgagtagtttatcaattgttattgctggattattaactgtaatcattgcaccattaatggcaaatttattataaaaaataaccctttattcaaataaaatgatatgtactggataatccatatcaaaacgagtaaagggatttctttttattatatctgactatatgtctctggactttctaagcgctcaaccaaacgctgtaatgattgctcaaaccgatcagtaaatggttcatcaaaataaagataaccattttcatagtcctcatctacagctgtttcaacaactacagtaagactttgataaacgctactaagattttcttttatatattttaattcctgatgattgtattcttcaataaaaatataatgatcacaaacctctaatgcatatttaagttcatcattaaaattatctttaataatttcatgattaagaattccaacttgaaacccacgaatctctaattctaaagcaaattcatttatccacattatgttacttgtattagttaataaagtaatatttttttctttattttttaaagttagattttttaaatcaaaaaaaacttgaagtaaatgccgaaccaaattacattcagtaattatacttgtatgttcagctgtatatttctttattttagggtgtgcacgtaaatcaattgcttttaaggcttgggaaagttcaaaatatcgatcgactaagtcctgttttgtaatattgttagtaatgctattgacgctaaaaaaatgatagttagtatatggtaaaatatcagtatcataaccaaaagccacttttgctttaacccctttttcatcccagccaataaaccttccaattcgtcttgctgcttgtcctgagacgattttaacatatccaaatttagccataattaatactcctctttctttataatttcttagcagcattaaatattcattttaataactattttcaatgccccttattcgcttatataaaaattcatttgttggtacttttagtttatgctttgatgccaaagaaattactgttccagcaaacatttcaacttcactgtaacgacgtacttttgcatcttgagccattgatggtaaacccagaggagccaaagtcctaattatctcaatataatgcttcaaatccgtttcagttagatcaactccctcgtaatgtgacaactcaataatttccttcattgctgcaatcaaggtatcatttgcttcccctggcattaaagcaccactataattggtattatatgccatacaagtctgatttatcccaacattcaacatgaatttagcccacatactatgtaaaatatcgcctttaacttcataattaatttttgcttgatcgaagaagctagtaagcttatccaacttatctttttgcttgaaatcagtgattcccaataagagctgtccttctttagtgtactttagagatgttccaaacttcattgcatccattccctgagcaaccgcataaattactttttctctcccatagtattcactaataaccttttcactgtcaatcccatttaaaacagaaattattattgtatttttatcaacacattttttaatttcctttattgcttcctctaaagcagtcccttttactgctatgattattaaatcaaatggaacggcattaaaacactcaactaaattaaataaaactttctcaccatttattgtaaatacagtttcctgatatgcttttttccttttttcatcaactataaatgtcactgcttctctagtaatgtttttgcaataaaatctccatataacattcctaaagcacccattccaataattccaactcgtttgatcacaataatatcctccataagaaaaaagctgatcaatgaccagcttttgcatcaagtttcaattaattatttagataattcagcgaaatatttgatcgttctaaccatgttagaagtatatgaattttcattatcataccaagcaactgtttgaacttcagtagttccgttgtccattggtttaaccatagtttgagttgcatcaaataatgaaccatagttaattccaataatatcagaagaaactaattgttcttcagtatatccaaatgatggagtagctgctgctttcatagctgcatttacttcttcaactgtaacttcaccttcaacaactgaagttaagattgtagttgatccagtaggaacaggtacacgttgagcagaaccaattaattttccgtttaattcagggataactaatccgatagcttttgctgcaccagttgagttaggtacgatatttactgcagctgcacgagctcttcttaagtcaccttttctatgaggtccgtctaataccatttggtcacctgtgtaagcatgtactgttaacatgataccagatttaattttagctaagttatttaaagcgttagccattggtgctaaacagttagttgtacaagatgctgcagagatgattgtatcatcagcagttaagatattttcgtttactccgaatacaactgttggtaagtcatttcctgctggtgcagagataacaacttttttagctcctgcatcaatatgagcttgagatttagctttagatacatagaaaccagtacattctaatactacatctacaccgatttcaccccaaggtaatttagaagcatctgcttcactatagattttaatttcttttccatcaacagtgattgaattttcaccagcttcaactttatcagctaatgcatatctaccttgtgctgaatcatattttaataaatgtgctaacattttaggatcagttaaatcgttgattgctacaacttcatatccttcagcaccaaacatttgtctgaatgcaagacgtccgatacgtccaaatccgttaattgctacttttactgccattctttatattcctccttgaatgttctttatgctcatattatattccagaaaggcaagaaaagcaactaatgtaacgggtttcattgaaaaaaattaaatatttcacaaaagattcataaatttaactttaatggaacaaaatctaacattattcttttataatataaatttagtgacttttataagcctagttttaccgcaatctttcttgccttttataggcttaaatgaataattattattttaattactatacttaaatgtggaggtaagataatgcatttagttcctacagtaattgaaaaaacaaaccaacgtgaatatgcttatgatatatattcacgactattagaagaccggatcatcttattaaccggtactattgatgataagatgtccagcagtattgttggtcagcttctctatttagaatcattagataacaatgctgatatttttatgtatattaattccccaggtggcagtatcaatgcgggaatggcaatctatgatacaatgaactttatcaaatgtgacgtttcaacaatcgtaattgggatggctgctagtatggctgcctttttactcagtgccggagctaaaggtaagcgttgtagtttacctaatagtgaaattatgattcatcagccattaggagcttttgaaggacaagcgagtgatattgaaattagtgccaaacgaatcttaaaacaaaaggaaaaattaaatttaattcttagtaaaaatacaaatcagcccatagataaaattgttatcgatactgatcgtgatcactttttagaacctgatgaagcgcttgaatacggcttaattgatgaagttatttaaaacgaccaacttatgaagtgaaccccaaaaaatgatgtgtacccagttttctggacacgtttaaatttagttttaaaaaaattatgccatggatgctaatctgtacaaatgaaaaagctgtagatgattttaatcaagactggtatagtgtttatggagaaaataaaggaatttgtgatttataaacatccttgaataaacaggaaaatatacatatagaaaaagcgctcaattatagtgaattactatagataagcgcttttttttatttttcgcagaacactatattctacgaaaaaatcagaatcttaaaagaatatcaatttattattgctatctcaaaaagaataaatatttcatttatcgttaattttggataaaatgattaacacaaataaatttattatgatgaaaataagaattgattaattttatctaacgattttcaaatattttttcattattaatttgttttttaaacacatcgaactataaaaacattagttatttactgttaaaatcatcagataaaacagactattatcttaatagctcaaatacctgataattactgtcaattcgtcgcttttttatttgaaacaacaacaatttatgatataattcggttcgtagaatatagtgttctgcgaaaatggaagggttggaggtaacaatgtattggtacgtagccagatgcaaaactggtagaactaaaaaacttgttagtactttaaacaaacaagtgaacatgaatgcctttatacctaaaagtgaaagatgttttggtagaggggaaacagctgagtttatagttaaggaaatatatcctgactatgtatttatcaagagtgatcttgatcaagaagcttttgatgaacaatttaaagagtattttaaaacgattaatggattagtagatttacttgagtataaagatacatatccattaactagtgaagagcagtctttgctagaaaagttattagataatactgatacgatcaaacatacaaaaggagttatagtggatcgaagattcgttcccactgatggtcctttagtaggtttagaaaatatgatcaaaaaagttgataaatatagaaggtttgcaacactggatacaagtattcttactggaaaacttgttgttgcaattgattattaatatgaactggtatgtcttatatgtattcagtaataaaactaataaaatactatctaatttaaatcaaagaaaagaacttactgcttttattcctaaaactgaagtatttcataggcaagcaaagaaaaagactactaaagatatgtttgataactatatctttgtaaagtcagatttaaaacaaaatgattttaatgatcttttattgtctatgaaagataagaatgatggactgattaaacaattagagaatgctgaagtacctgctttaagagaaaaagaaatagagttctttaataatatattagataaagataatgttgctagagtatctgttggttaccaagaagagggtaagacgattataacagaaggtcccctactgcattatcaagatcatattgtcagagtcatgaaacatcattgtacagcacaactagatttacctttctttgatagaaagattattctaggagttgaacttaaaagcaaggattaagtgttactcaggttaacttgataacacattagttctgaacataaagtctagattatttggggtaagggggaattgtatcttctacctcataaatatgactaaaacaggcgttgaacctgtttttttatgttcaaaaaggaggtataaagagtgactaaaatattagaaaaaatagaatcagaagtgatatgtattattgatgataaacaataccaatatacaaatggtaaagaggcttatcagcaattaacaaacaactactctattgcatctattaaagcttttaacaatcaaatcatcataaacttaaatccaaaagagaataacaaagaacaatattggcaagaagtttataagaaacaatgtggtgaagaaccaagtttcttttaattggtatattgaagggagagttgatatggcattgaaactaatgtatataactaataactctgacgtggctttgatagcacaaaagtacggagttgatagaatatggatagatttagaaactcttggtaaagaggaaagacaaaaaggaatgaatacagttaaatcaaatcattccattgaagatataaaaaaaatagctcctttgttaacaacatcggacatgttagtcagaattaatccaattaataaaaattctgaagaagaaattaataaagtgatagatgctggagcagatattattatgttacctatgtggaaatcagttgacgatgtaaatacttttttatcaattgtagatggcagagttaagacaacacttttattagaaacaaaggaagcagttgaatgtttagataaaattttagaattatgtcatatggatgaaattcatattggattaaatgatttacatttgtcctataatttaagtttcatgttcgaacttttaagtaatgggacagttgaaaaattgtgtaagaaaatagctgctaaaggtattccttatggatttggaggaattgcaaagttaggggagggaattttaccagcagaaagaattattatggagcattttaagtatggctcaacaagagcaatattatctcgtagcttttgtaattataaaaaaataaatgatattaaaaaagtcgaatatattttttctagtaatatgaaaatattgaaaaattttgaaaaatcactggagtataaaactgaagaggaatttataaataacagtaatgaagtacaaaggctggtggagcaaattgtaaaacataggagaaattgtaatggaattaaataaaggaaagttattggatttaaaaaataaatatggtgatgcatactatctgttagatagtaaccagtttagagataattttttagagttgaaaggatctttttcaaatatatatccaaactttaatattgcttactcatataaaacaaactatacacctaagttatgtaaaattgtaaatgaattaggtggttatgctgaggttgtttctgaaatggaattagaattagcattacgaattggggtggattatagtaatattatttggaatggtcctattaaaacaaaatcaacagtagaaaaatttctaattaatggcggaacaattaatattgattcgttagaagaattagaaatgattaaagaaattgtaaattgttatccagatcagtattttaatctgggcataagatgtaattttgatgttagtgatggagtggtatcacgatttggttttgatgtaaacagtgaagattttagacaagtattggaatttacaacaaaaaaaccaaatgtaaaattaattagtttacaatgtcattttgctaaaagacaattagattattggcctaatagagcaaaaggaatgattgatttaattgatagtatcggtattattcctcaacgaattgatctaggtgggggattatttggcaaaatgcctgattctctaaaaaatcaatttacaactgaaattccaaaatatgaagactatgctaatgctgtagcaccattatttatggagaaatttaaaggttgtgatcaattacctgaattaattattgaaccaggatcagcattagttggtgactgtatgaagtttgtaggaacagtgaaaagcataaagaatattcgtggtaagtacattgcttctgtattgggtagtcaaaaaaatgtaagtatgactggtattaatcctccaattgatgtatttaatgcttcagataaacaagaaatatataatgatttagactttgttggatttacatgtattgaaaatgatgttttatataaatcatataatggaaaactagcggttggagatatgattgttattaataattgtggttcatattcgttagttatgaaaccagcatttattcttcctaactttgctgtattagatatttctgatggaaaagaagaagttattaaacgtgctgagacttttgatgatatttttcatacatacaatttttaggagcaagttatgattattaatagaatattaaaaagattatttgatattgtttcgtctggtattttaattgtcttgttaattcctttatggattattgtttcgatagcaataaaactagattctaaaggccctgttttttttaaacagggtagaagaacgaaagatgggaaaatatttaatatgtttaaatttcgttcaatgaaggtaaatgctgagaatgaaggcgctggattatttaattacgaaaatgatccgagagtaacaaaagttggaagatttcttagaaatagcagtattgatgaattgcctcaattatttaatatattctttggaagcatgtctatagtgggtcctagaccctgtgtttcttatgaacttggtgattatgatactttaaacagaaaatataagaagcgatttaatgtaaaagcaggtcttacaggtcttgctcaagttaaaggaagaaatgatatttcatgggatgacaaggttgcatatgacaatcaatatgtagacttgtttaaaaaaagaggaatccttatagatattcaaatattatttgaatcagttattaaggtctttaaaaaagaaaatatatatgaaaataaaagtgatgaaaacatgagtgatatagaggctgcaaagttggaagaaaaagaaatcattcgtattgcacatctgccggatgagggggaattataatgaaatatgatgtagaaaatagaagaatttggttcaaaggtgaaattctaaatgttaatgatgctaaaattaatatcttggcaccaacgtcacaatttgggttaaatgtattcgaaggaattccatgttattggaatgacgaagaaaaacaattatatgcttttagattagatgatcattatgaaagactattaaaatcagcaagattattacaattggattgtaaatatacaaaagaagattttactaaagcattagttgatgtggttaaagctaatgaatatgatgaaaatttatcagtgagacaaaccctatttgttgatgaatttggttcatggggttcagaaggaccagttgaaatgtttgttgctccaataccaagaggtagaacaagtgcagaatacaataaaaaaggtttatattgttgtgttacatcatggagaagaattagtgatgaaaacttatcaccaagaattaaatgtggtgcaaactatattaatagtagagttggacaaagagaagcattaagaaatggatatgatacatgtatcttccttaacgaagtaggaaaagttgcagaaggacctggatcatgtttttttattgtcaaaaataaagaaattattacacccaaattgactgacagtgtattagaaagtattactagagatacaattctaaagattgcaattaacgaaggttataaagttacagagagaacaattgatagaacagaattatatatatgtgatgaagcattcttatgtgggtctgcaatggaaataacacctgtattaagtattgataaatatgaaatcaataactgtgaaattggaacaataacaagcgacatccatttaagatatttagatgtagtaagcggaataaacaaggattatatgagttggctaacaccaatttatgataaataaggaataacgaatggaaagagaatatgtaaaaggaagagtttcagtaataataccagtttacaatgcagaaaagtttatatcagaagctctggattcagtatttgctcaaacatataaggatatagaaattgttcttgtagatgatcggtcaagggataattctgccgacattatcaaagagtatatgaaaaatcatcagaatattatttattatttgcaaccaacaaatcagggtgctggggcagccagaaataaagctttagaattggctacaggtgaatatgtagcttttttagacagtgatgatatttggatgccaacaaaaattaagaaacaaattaatttaatgagtgagacgaatactcctttttcttatgcagcaattgaaatgattgatgaagctgggaaattgttaaaatcaaagagaaatattaaagaaacgtgcgattataaatatctactgcataacacaattatcgctacctcatcggttgtaattaacagaaatatattgggagattttagaatgcctttacgtagaggtggtcaggattatgcaacatggttaatgttacttcgcagaaatataatagcatatggtattaatgacactttagtaagatatcgggtatcaagtaactccttatcatctaataagctaaaaagtattaaacaaatttatgaaattcaggtcaatgatgagcatattaatatgttaaatgtattatttaatattctttgtttttcttttaatgccataagaaaatataaactataaacaaggaaggaagtaaaaatggaaaaagtaattgatgtttcttttataatacctgcttacaatttagagcattatattgttgaatgtcttgaaagcataaaaatgcaaacaaaaatagtctatgaaataattataattaatgatggttcaacggataatactttagacattataaaagaatacaaaaataaagatgaaagaataagaataatagataagcaaaatgaaggcgtatcagttgctagaaatataggtatagaaaatgctttaggtgattatctatgttttgttgatggtgatgattactttttaaatgattcaattcataaactattgaatcaatgcaagctaaataatttagatattatcagaggtcaatacacaattgttaatgaagtagaaaattatggaatttatcctagtaaaaatgtgtgtaatgatgaaacgataaatggtgttgaatttttaaaaagatcaatgaatgaaagatgtagcgaagtagttccttggcttggtttgtttaaaagagaatttataataaaaaataatctagttttcccaacaggaataaaatatacagaagatcagttgttttttttatctgctttacttattaaatcttccaaagtgaaagatgtaccaatttgctattatgggtatagagatcgaccaaatagttcaactgatttaaaatacaatagcaaaaaagtcagtgatatagtttatattacggagcaagaaatcaaattatgtaaaaataacaaatatgaaaggtatattttaaaatattgctcaactactctttctcaaatcattccattctataaaatagcaaatacctctcaaagaaaagaaatacaaactgaagtaagtaaaatcaaacaaaagtttaaaattaataatacttattcgcttaaaatatggtttaaaattttttctttgagaagatttccaaagattcttgacttattaatgaggaatccaacatgataggaataatatatatacaagatataaaaaactgtccttttttatcaaagtacactaaagtttttgaagaaaataatatagattataaaataatatattggaatagaaatgtgaataaagaaaatggcatttatcgaaaaggtaattttgttgagtattctttttatcaagacataagaaaaccaaaattaaaaaaaatatttggctttttaaagtataaaatgtttttgaataaagaattaaaagagtgtgataagttagtttttttaacaacattatcagcttttttaatgtttgataagataaataaatataaatatatttttgattttcgagacccctcttttgaacaaaattcactctttaaaaaaatgattgataaaataataaagaaatcatattttacttgtatatcatcaaaagcctttaaaaagatattacctaaaagaaaatacatgttagctcataattttagatatgaagatataattcaggcaaaagaaaatggatactgttttaaaaagaaagattatggtgaaaaacttgtagttacctaccatggcgcaataagagaatttgaacatataaaaaaacaaatcattttactgtcacaagatgaaagatttgaagtctattattatgggtatggtagtgaatatgaatccttaaaattatttattgactctaataattttcaaaatatacatttgatgggagaatacaacaacaatgacaaatacaaatttctacaaaaaacggatataataaataatcactatccattatgtaataattatgatttatgtacgagtaataaattttatgactcactaatatatcaaataccattgttgtcaaatgttgggtgtatagacgatttggaatcaaataaactatttgggattggcttaaaattaaatacatttgatgatttagatactctatatgagtggtactttggaatagaaacaaataactttatagataattgtgaaaaaaaactaaataaaatattagatgatgataaagaatatttaaattctataagaaaatttgttgagtatggtggtgaaaaaaatgtgtaaattgactgttattattcctatatacaatgttgaaaaatatttgttaaattgtttggaaagtattaatgatgcattgaccaatattgataatgatgatgtagaaatattgttaataaatgatggaagcaaggataactgtaaaagtatttgtgaggagttcataaaagataaagatgtttttagattaataaataagaataatggtgggttgtcctctgcgaggaatttaggtattaaaaacgctttaggtgattatgtgagttttattgattctgatgattggatatctattgattactttaacgtaatttttaaatatataaataagttatttgatatgttagtttttggatatattaattcaaatgataataacggagtagaaactatgcataccttggaagatagagtatacatttcttccagtatacatgagggaattgtggatattgattcaaatggatatatgatgaaccttgcttggaataaagtatataaaaagtctataatagaagaatattttattgatggattaagttattgtgaggatatagtattcaattgctcaattcttcaaaatgttaaatttatgataacttgttctgaaacgatatattattatagaacatcaaattcaagtttaactaataataggttttatgataatttcaaggaattaatccaattgtctataaatgctcgaaagaaattatacgaatattataatattatacagaatattggcgaaattaattattataacaaatcagtagagttatacttatcctctattacaaatatgtatagaaaaaaatcaaattacagatttatggatagaattaaatggttaaggtatattaaatctaaaataaagaatatagaatatgataagggtaaaatgtctgatgtggaaaacaaagtagcgaatattatttgtttatttccatgtgttattacagagatagtgttaaaattattgttttttataaaaaataattttaataacatatattatattcttagaaaaagaggaaatgagggtagataaatgttgtatattgaagttgcctcaggcggtagaggttttttagaagaattgtacaatacagagtttaataattatcgctttattaatgaaaaacaaatgacagaaaaaacggaaaaaaaccataaaattttaagatcaattttttattcgaaattatttgatatgattggatatatatatataaacaaaattgaaactagcaaaaatgcattgattacttataatagatttctcaaaacaaacaagccgtattatattatatgtgaaaatcctacagcattatttcattataaattaaatagaaataatggcatttatgcaaaaaaagaaatcaaaaaaagaatagacgatgaaaatttaaaagcaattatttgtatttctaaagcatgttataatacttttcaagaagttttgggtatacagactaataaattagtacaaatatatcctttaattaaagatcaaaggttgactttaaagaaatctagtgaagataaacagttaacatgtctatatatttcttctaactttgaattaaaaagcggtttagagttactcgaagtgtcagaaaaaattcagaatgtgaattttatttttgtaactagggaaaaaactatttcaaaagaaatattaaatagaataaaaaaggcatcaaatattcagttgattgaatttaatcttaacaaaaaagaattaaatagtttatatttaatgtctgacatattaatccatgctacaagacaagatagttttgggctagtagtacttgaggcagtgaaaatgggcttgcctgtgttagctactaatatgtatgcaattaaagaaatggttatagataactataatggttttttggttactccaaaatatcaatttttcgatgataatgatattccaaatgcatctgtttggaatcatagaaaatcaacgattaacaaaacttttgttgataataatattgttaattttttagaaacaaaaataaatttttatgataaaaatagagataaactagaagaaatgtcaaaaaattcttttgagttatcacaaaaagaatttagtgagaactctataaaaggaaaatgggatgatttattccatcgcacattaaggtagtaccatgaaaaagaaaagtttaaatatatcaaaaatattattttacatatttactataacattagttatttcaaacttaagtttattttcaaataatattattagattgttagtactttatgttttatttgctggttttgcaatatattatctatttaagtctaattttaaattacctgtaagttttgttatattagtttttgttgcactacttattgaattttatttgatacttgttaaggattatagctatagtaatgatcgtgttatatttttaattatggatattgggatgttgtggattggctataatgctagaaaagagaactattataataatattttaaaaatttatgttttgtcttgcgtattttcatcaatattttatctactaaaatttgacacaagcttgatttatggatatggattgaaacattgtttggcggtaaacatcatttttgctttttttattgtattaattaaaaaagatttattaggaataaaaagtaagttattatgttgcgctgttttcttatttacaattataaatcttaattcaagatcaggattaataggattaatatgctgcatatgttacttagttgttaccaattatttaattattttaaaatatataaaaaaacacataattccaactctatgtggtattactttagtggtgttttttatacaaaaaattattggggcaatatatgttgctttacgatttgatagtttgcaatcaatttcgttggatagatacagcgctgataggttacctatgatacgtgaagggttgttgttgtttaaagatagtaaattatttggaatcggaaatacaagtataatacctcaaagtttttatgttgaatgttttcctattgatgttctagttcaattgggatttgtaggattcatattatattttattttttatcttattttatttattttgctatttaaaaataaatatcatggttctaatttattattagcaaaagcatgttttattgctagtttaataatttcactattttctgcaaatgcaccaatgggtcctggaacagcgttttcttttatgtggtttttaatcggtgtcgcattgcaaaataaacaagaaggtaattacaatgattaaaaatagaaatataggaatagattatttaaaaataatttgtgtgtgtttaattttatttatgcatattttaggacaaggtggtattctcgctaattctaatggtattacaaaaatcggatataaaacattgcaagtattatttatgtcttcgattaatatctttggattgatatcaggattcttgttgattgataaatactattctcgtgctagaatttttcagtattttttttgtatcttatttgtcatgatagtttgtggagttgcttcatgtgttaatggtggatcttttttatcttatattataaattttaatgactctttaactacaacatattggtatatttcttgttattcacttatattattattatttcctttttttaataattttattgaaagtctagattatactcaaattaaaaaactactaattatatgttttataggcttttctattatacccacaattattggaaaagatatattcattataaattatggttatagttttatctggcttgtttttttgtacttcataggtgcatttattaaaaaatataatattgtgtgtcaatcaaataaactaatatttagtttgtttttattaatcatttgtcaacttataactatatttgttacatataaatatagctatttaaatatgatttacccttttcttacatcatatacatctccttttttactattaacgtcagtagtattactcttactatttaagagtaaaaaaagcgataatataaagttaaaaagtattattgcaccattatcaaattcgtctttaattgtctatgcagtccattgcaacatttggttttatagttattttaaaaatgctttcaattatattgcacaatataatctttttattgggctatgtattataagtatgtatattttattattttattcgtgtatgacattaattaatattggcgtaagtattatttcacaaatattttcaaaaaagttttttaaaagggggaattaaaatgaaatcagtaatgattgtaaccttatgggattcgaataattatggagcttatttacaagcattttcattaggtaattattgtagaaaactaggatacaatgtttcgtatctagaagattcaaaagaagaccataagttaaaaaatcaaatatcaaaaaaattaaataaaacagtatatcaaataaaattagctagaaagttcaaaaaagccaaaaatgttttcaaattagtttcacattcttttgcagttgattatgttttagtcggcgcagatgaagtatggaatgtaaacaataactattttcaacatctagattattatttaggatacaatttaaactcaaaaaaaataatatcctatgctcctagttgtaatggaactaaaaagggtgaatttttaagtgtttattcaaacaaaaattttacaaatttcaataggatttcagttagagataataatactgctagtttagtatattcaatacaaggcactaatccaaaagttgttttagatcctacttttctaacagataattatgaagaatttattattactccatctatcaataattatgtttttgtatacggatatggatttttaaaagaagaaataagtgaaataaaaagatttgcatctgatagaaatttaaaaataatatcagcaggtgcttttttggattggaccgatgaacaaatatgcgcttcaccgtttgaatttttgggtttaattaaacatagtgaatatgtatttacttcaacatttcatgggacagtcttttctattatttttaataaaatatttttttcttttgcaaggaataacagcaaagtacttgaaatattagatttatttgatttgaataagaggaatttatccaactattataatgggaaagaattagataataatatcgattatgacaaggtaaatttaattttgaaaaatttaagaaaagagtctaaacagtttttattggattcgtttaataacgattaaaggaggaaaaaatgttagattttttaaagatgcacaatatagatgatgttatttgtacagttagttcaatgaatgagttgcctaattcatataaaaccaaatttattattgatgctagaagcgcagttttctatgctatgggcattgctcaaaagaaaaacaaaaaagttgcagtattaataacatatgaaggactattaaatgcttattcaccgcttatagaggcttggtttcaacactcaccgttatgtgttattttaatagaaaattgtagtattgactctttgttttatagatgttttgagaatatttataacagcttaccgtgtacaattatcaattttaatcgacctatacttattcaaaataataatagtatagaaaatgagacgtatgaaattaattgttcaaccttaaaccattataatattcatttgtatcatactttggatgtatgtttgtttgaaaataaaaataaggaaaccgtattcgaaaactcttacggaataatctcacgatttttaggaattacaattttaaaaaaaagcaataacgtattgatatgtaaatatgatgattttttaaaagatattaattgctttaatagtaaatatttgaatgaaaatgtaaaagtagttattatttgcaaaaatgaatttaaacaatatcagtggttacaaagcaatagagtgaaaatatattctatggatgattttgataattttattaaaagtaaggaagctagtattttgatattagaaaaggagaatatgaatgtatactaatttaaaaaatgttcaggtagtcatctcattgttaaaacaacataatataagtaaagtagtaatttctccgggtagtagaaatgttccatttgttcatagtatagagcaagatgatttttttacttgctattcattcgttgatgagagaagcgcagctttttttgccttaggcttatcagaatcatctggagaaagcgttgtcttaacttgtacatcttccactgctactgcaaattatttgccagcaataaaagaggcatttacatctaaatgtaatctcattgcattaacatttgacagagattaccgtaaattatacaaaatggaagatcaaatgattaatcaagttgaaatgtatagggaatattgtctaagttctattaatataccaattattaaagaaaaggatgatttatggtatgctacctctcagattaatgaagcttttttaactcaactgcatataaaaaatggaccaatacaagtaaacgtgcaagtagatgattttggtgatttttcttgtaatgaactaccaaagtatagaaaagtaaattatgtaaatgaagaggatttttttaaataccaagacggttttaaaaacaaattatctcaatttaatagaatattagtgttgtgtggacaagatatgtctaatgataacgacatgataaaatacttagaattatttcaagaaaaatattcttcagtagtttcttatgatgatttttcgattgctagatcttcaaaatttatcaaaacattaagtatcactgaatctatgcatattgaagattttgaacaatatgcacctgatttagttattactattggaggccacatttggtcatttataaaatataaattaagacatgtcagcgataattttgaacattggaatatttcaaaatatgctgaaactaaagatgcatttaattcattaacatattactttaattttgagagtaaaatattttttgagaatattgtaaattgtaactttatttccgataaagtctactatattcagtgggaaaatagagttaataatgtagtttttccaagaatgtattattcaaatttttatgcgataaaaagattgttagaagtaattcctgaaaattctttgttacatatgagtatcttaaatagtattcgaattagtaatttcgtaggaaccccatatttgacggaatgttatgctaatttaggaactgatggtatcgatggatgcttatctacatttttaggacaatctgccgatataagtaagttttcctttttaattataggtgatttaagctcattatatgattatggaggatttcaatatttacaacaacctaatcaaagaattatgattattaataacaatgttggaagtgaattttataataattttggatcctatatagatactgtagatgattttataggtgctagacataattctgcattaaaaggaatcactgaatttaataatgtagactatttatcttgtagaaatgaaaaagaattcgaagatcaaatactgaaatttgtttcctcaaatgaaaaacctatcgtatttgaagtatttacagacgcatcaaaagatacaagtatattacaagaatattataaacttaatttacattctgattttaatattaaaatgaaaaaagtattaaaaaaacttaaaataattaaataaattaattagtaactattgaggtgaaatagtatgaaaaaaaagattgaaagatttctgaaatacatattacatggcattccaattataaatatacaaaaagaactggtttatctaccagaaagtacgatattggaagggaagaaaattctgatcacagatggtggatctggtattggatttgacattgcaagaaaatgtattgaacatggtggagaggtaataattgtaggaagaaatccacaaaaattaaatgaatcaaaagataaacttggaataaagtgtagtgtttatcaatgtaatctagtaaaccaaaatgaacttgaagatttgatagaatatacgaataacaattttattaatgtattaattaataatgctggtgtttcatatcatgaagctagttgttttgatgtggatttcaatggttatcaagaacaatttgatattaacttaaagcctccgtattttttaagtacaagtttttgtaaaaaattaattgaaaataatatgattgggaatgtattaaacattatttctgaaaggggattgtactgtgatgacttgccatatgagttaacaaaatgtgcattaattgattttactaaaggattatcgcaaaaagtgattaagaacgagattagagtaaatgctattgctccaggagttacagcaacaaaaatgactggttataaagaagatgaaaatttatataatgaatacacttgtggaagaggaatttttttatcttcagagattgcacaaattgctgtattttctatatcggattatttcgattgtatttctggagaggtattatcatgcaatcaaggtaatcatttaaggtcaaattatgattaaaaaattaattcaaaaatatatagctttacctaaagccgtaaaagcatctttttggttcgtttttgctagtgttattcaaaaaggtatttcatttataactactccaattttttctcgcatgttaacacctgctgaatatggagtgtttacattatatcaatcttggttccctttaatattagtatttacttcgttgaatctttcaggtggagtttttaataatggactaacaaaattcgaaaaagacagagatgtttttatttcgtcacttttatttattagtactacaataacgcttattctctctgtaatatgtttgatttttagtgaaaacatatctcaacttttaagtttatcatttaattacattttactaatgctaattcatttgttattcgaaccagctttttctttatggagtgctcgtgaacgatatgattataattataaaaagctaatatttgtgactatatacatcgcaatttttacacctctatcaggaattattggaattaaaatgtgtacagacaaatcatttgcaagagtttttacttttgttatttctcaagtattagtatatttattaatttttatttctatttttaaaaaatcaaaaaaaccatttaaaataaaatatatcaaatatgccttactctttaatatcccgttaattccacattatttatcgatgactatattaaatcaatctgatagattaatgatacaaaaatattgtggtataagttttgttgctatttatagtattgcttattcactatcgatgataatgatgataatcattagtgccattaataatagctttattccatttatttataaaagaatgaaagataatgatacagattctatcaaagaagtttcaagtaaactattaattcttgtattatttataacgatactaccgattttcttaggaccggaattagtagctgttattgctccaaaagagtattcagatgcaatgtgggttatcccaccagtgtcagcatctgtgttttttatatttttatataatttatttgctacatttgaattttattatgaaaagaataaatttgttacaattgcatccttgctaggagcacttttgaatatagtgttaaacatgttgttcattcctaaattcggttttatcgcagcaggttataccactctaatttgttatatagttttttcaattgctcatgcattatttgcaataaatataatcaaaaaacaacatatgagttatccgttcgatttaaaacttgtagggttggtttctattgcgttatttgttctaatgatatttataacattattatatagtaacgtgttctataggattgtttttctatttattatactaattctaatattagttaatttcaaaacggtatttaggatacttaacagtataaaaaaataataatggaggtacataatgaaaataacagtagcaggaacaggatatgtaggattaagtatcgctacattattagcacaacatcatgaagtgatggctatagatattattgaagaaaaagttaatttaattaacaataaaaagtctccaattcaggataatgaaattgagacttttttaagtacaaaaaatttaaatctagtagctacattaaatgctaaagaagcatacagtgatgctgaatttgtagtgattgcagcacctacaaactatgattcaaagaagaacttctttgatactagtgcagtagaagcagtaattaagttagtaatggaatataatccagaagctgtcatgattattaagagtactatccctgtaggatatactcaaagtattagaaaaaaaacaggatctaagaatattatcttctctcctgaatttttaagagaatcaaaagcgttatatgataacctgtatccttcaagaattattgtgggaacagatatgaatgatcctagattagtagaagctgcaaatacttttgcaggtctactgcaagaaggagccataaaagaagatattgaaacattaattatgggatatacagaggcagaagcagtaaagctgtttgctaatacttatttagccttaagagtgtcatactttaatgaattagatacatatgcagaaatgaaaggtttagatactaagcaaatcattaatggtgtatgtctagatcctagaattggttcacattataataacccgtcatttggatatggtggatattgtttaccaaaagatactaaacaattactagctaactatcaggatgtaccacaagaaatgatgagtgcgatagtagctagtaatagaaccagaaaagatttcattgctgatagagtattagaaaaagcaggatattatagttatgatgaatataatgagtatagtcctgataaagagaaaaatgtagttattggagtttatagattaacaatgaaatctaactctgataactttagacaatcatcaattcaaggtgtaatgaaacgtattaaagcaaaaggtgcagaagttattatttatgaaccaactttaaaagatggtgaaacattctttggtagtaaggtagtaaataacttagaagaatttaaaaaacaatcgcaagcaatcatagctaatagatatgattgttgtttagatgatgtagaagataaagtttatacaagggatttatttaggagagattaatgataattttaattactaaaacggaggtgaaataatgcaattaaatactataccatatcaaagtattctagatttattatgcaacaaactagaattaaatgaacaagtaattttagatattatagattcaggttattatatgttccaacaagatcatcaaatactatatattgatgatttatatgaatgctatttcaatattgtaaaaagaaattttacaggaaatattgataaagtaccattctatagtatatctagaagactaaaagatgctgataatgatggattaagtttgttggaattattaacagaagaaaatagtttttcgaactatttaaaggaatatggattaacatttaaatttgataaagaaatagaaatgtatgttaatggtaacaaggttgatattcctgatgaaggcaaatataaaccctatctaaaaaatagattctcatatgattatgcatttaaaggttatgcttttgatgatcaattaatgaataatgagatattagaaagagttaagtatggtccagagttctttggacatctttttaattacgtagataacgatgatgaaatcattgataattatctagaacaaagtaaattgtacaaatttgagtacttagtacctattgaagatatttactttgaaaattatgaggaactaactaatgaagaaaaacaatatcacatcttagcgatgatgatgttaagattgtatttctataaatatgataaagattttgtagaaactgatgaaatgaatccactaatggtagtggctaattataagtccctttctagcaaatatcttgtaaataaaactgagttagatgatgaggcactaggctattagtctagtgcttttttattctatataatatctgaaaattatgaaaagatccattttatataattggaagtttttacttttttagcaaaaactattattggtttgaatattcatctttgttgtttgattgaacgtctaataaaaaaagaagagatagtttcacatattaatattgttgattttgaaaaaaataatcaagaatttatcaatggagttagaattagctttaaagcgattgctaatcagtataatataacaataccaattagtgaaattgcttatatttatgattacgttttaaataattataaaacagatatgtcaattgatgagatttaaaaagagtaaaggggtgttttattatggcattagtacaagtaaattttatttctcaaagtttaaaaagaacagtttcaatgaatgtaatattaccggttgataaatttctttttaaaggaaattgtcaaccagttaaagaatataaaactttatatttattacatggtttattaggaaattatactgactgggtaacacgaacaagaatacaagaatgggcagaagcaaagaacttagttgtagtcatgccatctggtgataattctttttatgtggatcaagaagtaaagaacaatgacttcggtatatttattggaactgaacttattgaagttactagaaggatgtttcatttatctaatcgtcgggatgatacttttattgccggactttcaatgggtggatttggtgctctaagaaatgggttgaaatattatcaaaattttggatatattgcagctttatcaagtgctctaaatattttcgaattaccagttcacgatgaatcaagatgtgtaatgggtgaagatagttgttttggtgatattgatgaagcatatctgagtgataagaatccaaaagtttgtttggaaaatttaattcaggcaaaaaaagaagacaatactattgtttttcctaagatatatatggcttgtggatgtgatgatgaactaattggagtaaatcgaaaatttaaaggctatttagaaaatgctggttttgatttagtttataaagaggatgtaggaagtcataattgggatttttggaataaatatattcaagatgtattagaatggttacctttggatccttatgaagaaggaattaacagcggtaatgttaaataggcaatgttttttattagaattatatatttataattaaaagctatatttacttggtaataaagaacgataattgtgacaggataaattataactaaaatggtaaataaggaataaatatttcaataccagaaatatgttttgatatgaatagtataaaacccattataatattgactttataatgggttttattaatttagattacaatcgaataaattttttgtcagcagaagttatgttttcttcattagaagtatagcgttctactttcatatgaagatcatatttatttcttaattctgtaatttgctccatcattatagtagcatgatgagcatcaattgatttttgatctttccaactatcaattaaaagtatggtttctggatcattcatggaaaagaaatactcatatctttcatttcctttttctgctttaatagcatcaacaataccgctggtcaccatttcttctgcaaattttctagcatttccgtttattccagtgtaataaatgtttactgtgatagacatattaattatctccttatgtataaagattatcttatttaattatagcatattttaaaataatctatcatatttttaaaagcgattcttatttgtaaaaatagttattcttatctaacgaaatagaacgtattattcgaatacttgatggacaaggggtataataagggcaagaaaaggaggtgctcttaaatgaacacaaaacaattagagcgtatgcaatatggaaaaggtttatcgcagcgttagatcaaagtggtggaagtacaccaaaggcattaaaatcatatggtattgatgaatcagcgtatagtaatgataaagaaatgtttgatttaattcatcaaatgcgtagtcgtattattactagtaaggcttttacctctaagcatatattaggtgctgttttgtttgaaaagacaatggattctcaaattgagggtgtagatactgctgaatatttatggttaaagaaggaaatcgtgccatttttgaaaattgacaaaggattagaagtagaaaaagatggtgttcagttaatgaagccaattcctgaactagaagcaatattaaacaaggcaagagataaatatatctttggtacaaaaatgcgtagtgtaattttggaagccgatccagcaggtatcaagaaaattgttgatcagcagtttgaattaggattacaaattgctaaaactgggcttgtacctattttagagccggaggtatctattttaagtacctcaaaaaaagaggctgaagaattgttattgaaagaaattaatgagcatctaactttattagacaatgatgttaaatttatatttaaactgtccattccaaccatacctgatttttacgcggaacttatgaaagattcccatgtagttagggttgttgctctatctggcggttatgatagagagcaggcaaatgggttattaagggaaaatcacgggcttattgcgagtttttctagagtattattatctgatttatcaataaatcagactagtgttgagttcgatacttgtttggagaatgtgattcttcaaatatatagggcatctattgtataatgatgttaagcttatctatcatgtaattaaatgacaaataatcaagataagttataaaatatttttaattaaagggaagatttaaaataattgattatatcaatgaaattaaatcttcttttattatttattagttataaaatagtttgtaaattccttaatatatttttcttttagatttttgtgataagttattccatattctattgtcatttgatcatccataaatggtaaagcgacaattcttttaatatgtgttggaatatatatttctggtaaaatagctacaccgtaattacatttagcgaaaagaatagcagcctggtcatttttacataaaagatgaaaatgattttttcatggagagcaataaattcttgtaatttatctcagtattaaaatgggataaagcggggatgcaaagtagtaagtggtgtatcatataaatctataaaacatatttctttttctttagcaaacggggaattttcagctatgattgcataactggaaatgttttttatttttttaaatatataatcgtgagcctcagcaatcatctcttttgtactgattaaaatgtctaattgtttattatcaaatagagattttagaataaaataatcctgaataataatctggggataaacagttggaaattcttcttttaattttattaatggtatttctaatatctcaagttctacttgactagaacagccaattcgtaatatcgaaagtttttgactggctagttttttaacttttttctcaaccatatatattttttggagaatatcttttgcttcactatagaataatgagcctggctcagttgattttaccattttggaagttctgataaataatgacgtatttaattcttctaaatttatgatatgatgggcaactgctggagcagtaatatataattcttcagcaacctttgtaaaattcaatttatctgctattcgcacaaaacattctaattgttgagtattcatgaaatattcttcctgacttgtaaatatagtatttttggcaaatggggtgtagtcttaatcttttgtgttactttaggagttatttgtggcatgttatcaggaagtttttgtgcgatagcttcagctggatttgctcaaaatctaagacagaatatgtattataaaattcatgaatattcttttgcaaatattgataagttttctacttcaagtttggtaacaagattagtgactgatgtaactaacgttcaaaatgcacatatgatgactattcgtgtggcagtgcgagcaccatcatgctggcattttcactagctgtttcattaatgataaatagggatttatcattaatatttttaattgcagttccagttttagaggcaggtctttattttattgttagtcgttcacatccatattttgaaaaggtatttcatatctatgatgaattgaatagtgtagtacaggaaaatttggcaggaattcgggtagttaaatcatttatatgcctataatgcagtttatggctgtttgttgtttctttgctggtttagagcaaaaattattattcttataaatgcatcaacgatgaccacaggggacttatcaagtatgattgcctatgcaatgaatattttgaattgtttgatgatgttattacaagtattggtaatgatcaatatggcaagagcatcatgtgaacgaatcattgaagtttcagatgagaaggttctttaaaaaatggaagggaacctatctatgagatgcaaaatggggcaagtttatctcgaagacaaaggcaattgctttctatcgcttgtgcggctgttgcaaatttaccagttatgatcttagatgaagcaacttcttcgattgatattaggacagaagtgcttgttcagcaaggaatggataatttaatgagaggtagaacaacctatgtaattgctcattgattatcaacggtttgtaattctgaaactattattgttttgaattttgggaaaattattgaatgggggagtcatgatgaactcatttcaaagcatgatgtttattatagtctctatactgatgcttttgaactagagtaatatgttatgtcaaaagtgcttatgaaaatcctatttttgtataggtatctttgaaagaaatagtaagtatgtgttctgatagattataaaaagttaaatattcatataaaaaaggtggatttaaaaggtctataatccacctgatttcaataatatatttttataaattataatggcgtcccctgcaggaatcgaacctgcacctaaaccttaggagggtcttgtaatatccattttactaaggggacagaactagcttattatattacaatttttatttattgcaaataaactatgctcataaattttaccattactattaacaaaatgcaaaccaacttttacttaaaaataacaattaatgcttttggaaaagtgttataataaatatacaagtaaggagttgataaaatggataaaattgtagaagtatgttgtgggagttattatgatgcattacaggcacaatacggtggagctagaagaatagaattgaatagtgcattacacttaggtggcttaaccccatcattagcaactttattaaaagttaaagataacacagatttagaagttatttgtatggttagacctcgtggtgctggtttttgttacaatgatgaagattttgaggtaatgaaactggatgcggaaatattacttgataatggtgcagatggtattgcatttggatgccttgatgaagaaggagatattaatattccacaaacccgagaaatgatcgatattattaaatcatatcacaaaactgcagtatttcatcgtgctattgattgtgttaatgatattgacgaggcaatgaacattttgattactttaggggtagaccgtattttaacgagtggcttacaaggtaaagcaactcgaggaaaagaaatgattaaatatttgtatgatgcatatggtgagaatattgaaatcttagcgggaagtggaataaatgcaggaaatgcgaaaaaaatgcttgattatacaggaattaagcagcttcatagctcatgtaaagattggcatacagactccactacaagtcgtgatgaagtcaattttagttatcacggtgatgattatgaggttgtaagtcaagaattagtagaaatcctagtagagctagttgaaggggaataggggttgacattatctttaatagtgttaaactataagcgataaaagaatcggtaggtgagactaccatagggatacgggttgctaccgcaaagcagtggagacactgtgcgctggtcaacagttcttgtcgtgaaggcaaaaactaatgcaattacatggccctatgatgttgaagcttgaacgagataaagttattttcatgccttgtcgcgtttgagcgatgaggcttttattttgtggaggtgaagaaaatggatgattatttatcgatgaattttaaaagatggctttttgatgatgggataattacgtccattttcgcctagccatcttaatgatggctttttctatatctaaaattttgaaaggagaaaaagaatggaagagcatggccggtatgacaatgatgtttataagtcccgaataatggcgatgccattctttaggatagttttgtcatactctaaaatttaatttggagggtataacaatgagaagatttaattcaattaatgagagattagtttttgcgagtgagaataaaactaatcaagttttagatagttttgaaacaaataaaatgggaatcacgaatgaaacagtcaaacatcatagtgatgaatttggtaaaaatattattactaaacaaaaaaaagattctatattaaaaaaaatatttaacgcttttataaatccatttactgcaattttattaatactagcagtagtatctttatttactaatgtgatttttgcagaaactagtgaaaaggatccaactacagtaatcattattgtagttatggtaatgatatctggaatattacgctttattcaagaacaaagaagtgggagtgcagcagagaagctgattgcaatgatttcaaatactacaaatattaaacgatatggacaagaagcaaaagagattccaattgatgaagtagttgttggtgatattgtatatttgagcgcaggagatatgattcctggagatttgagaattattgaagctaaagatttatttattagccaagcaagtttaacaggtgaaagtgaaccagttgaaaaattcgcaattgaaacaactgtagggacgaatgtgcttgaagcacaaaatctggcttttatgggaagtgatgtaattagcggaagtgctgtcggtgtggtaattgcgacaggtgatgaaactatgctgggaagaatttctattgatttaaataaaaagagagaattaacaacttttgaaattggaattaattctgtatcgtggcttttgattcgttttatgttagttatggtacctgttgttttatttattaatggatttactaatggagattggttagatgcaagtttatttgcattaagtgttgctgtaggtttgacacctgaaatgcttccgatgattgtcacaactagtcttgctaaaggctctcttgcaatggctaaggaaaaaactataattaaaaatttaaattcaattcaaaatcttggtgctattgatattctttgcacagacaaaacaggaactttaacacaagatgaagtaattttagaatttcctttagatgttcacgggaaaattgatttaagagttttgcgacatgcatttttgaatagttattatcaaacaggattaaataatctaatggataaagcaattattaatagtacgttggctgaacaagataatgattcgagcttaaaagatttaacaaacaaatatgaaaaaattgatgagattccatttgattttcaacgacgaagaatgtctgttattattcaggatcaagatggtaaagtacagatggttacaaaaggagcaattgaagaaatgctcagtgtttgtagatatgttgagtatcttggtaaagtttggccgttaacacaaaaattagagaaaataattatcaatcaagttgaacaacttaatgaaaaaggtttacgggtcttgggagtgagtcaaaaaacagatcaggatttagtacaaaaatgtaccgttagtgatgaaaaagatatggttttaattggatatttagcttttctagatcctgcaaaagaatcaacagccccagcgataaaagcattgaaggaacatggtgtagcaacaaaaattttgacaggagataatgaaaaagtaactaaagcaatttgtcaaaaggtaggattgaatgttgaaaatattttattaggccaagatgttgcaaagatgggcttggataaactgaaggaagttgtagaaacaacaacaatttttgcaaaattatcaccggaacaaaaggcactgattattaaagttttaaaagaaaatggacatagcgttggatatatgggcgatggtattaatgacgcattagctctaaaggcaagcgatgtaggaatttctgttgatagtggagtagatattgctaaagaagcagctgatgtaattttattagacaaagacttaatggttcttgaaaagggattggttgaaggccgcaaagtttatgctaatatgattaaatatataaaaatgacggccagttctaattttggtaatatgttttcagttttaattgcaagtgcatttttaccatttttaccaatggcaccaattcagttattgttgctaaatttaatctatgatattgcttgtataaccttaccgtttgaccgtgttgacgaggagtatttaaaaatccctcgaacatgggaagcatcatcaattggaagatttatgttatggatgggaccaattagttcaatttttgatattatgacatatgtattgatgttttattttatagccccaataatggctggaggaagttatcaatcattaacaaatcctgattatttcattgcagtttttcaaacgggctggtttattgaatcaatgtggagccaaattcttgttattcatttaattagaacagcaaaagtaccatttattcaaagtaaacctgccctatttgtaacgatttttacattattatctgcatttgttttaacgcttattccatttagtcacttagctaaagcaattgggcttactagtttgccagcttattattttggattattaataataattgttattttatatattgcattgacaacagtagttaaacgtgtttatctaaataaatatcacgaatggttataaaatgtatgataaatatgttataatcaagcggaataaggagtgattagatgcgtaattttaatttagatgatgatttgaaacgtcatgttaaacctggattgataatttcagcgtttacagtttttttgatatatttacttatgaatttaggtaatatttatggaatgatcagcacgttgttagggacgctggtatatttgttttatgggattattattgcatatattctcaatcagcctatgaagctgattgaaaaacaaattacaaaatactgtacaaaaactagttttttatatcgaaaaaaaagaggtttatcaataattgcaacactgatactatttatttgtttaattgttttgattgctagtatcgtaattccaaatttaataagcagtttaatttcattgatcagtaatacttctgcttttctaacatcagtatttaataatatcgatgatatatttatctatttcaatattgattttagaatggaaaatattgctagtgttaaagatttaatcaatatgccttggcaagatatggttggtcaagcactagatatcctaactagaagtgctgggggaatcatgaataatgcaacaaattttttatctacatttggagtagtatttacaggatttattttttctctatatttgcttggaaataaggaaacttttttacgacaattaagaaaagcaattggagcactttgtggttataaagttacttgtgtaatttttgattatgcacataaaactaatgaagttttttcaaattttatcagtggtcaattggttgaagcttgtattttatgggtgttgtactatgtaactatgaagctgtttaattttccataccctgaattgattgctacaattatttcaatattttcatttgttccattttttggtccaattgcagcaatgtttgtaggtgcagtcttaattttatcaaaagatgctttgatggcaatttggtttatggtatattttcagattttatcacagttagaagataacttcatttatccgcgtgttgttggaaactcagttggcttacctggaatttgggttttattatcaatttttgttttcggtgatttatttggtgtatttggaatggtcattgcggttcctagtgctgcttgtttatattcattagccagtgaagtaattaatatgattctaaagaagcggaagttagttattactgaaaatacaattgaacaaaaatgattacctgcataatttgcaggtttttgtttatttagataaaaataagagtttgtttagtttattcaagcaatcaatatgatataatcatgaaaaggagaaaaacgatggagtatctaaaaattaattcaatatctgataaattacctttagacgtaattgtttcagcgccggaacacccaaaagcaatttttcagattgttcatggtatgtgtgagcataaagagcgttatttagattttatggaatatttaaatgactgtggatatgttgttatcatacatgatcatcgtggacacggaaaaagtgttttagatgaaactgatttgggttatttttatggtgaaggtgcccgtgcaatcgttgaagatgttcaccaattaactaattatattaagaaaaaatatccaaatttaccagtttgtttatttgggcattcaatgggttctttagttgtaagaaattatattcaaaagtatgatcatgaaattaatgcattaatagtttgtggcagcccaagtaaaaataaattagccggattaggaaagctattatgcaaagcgatagcaatggtcaagggggataagtatcatagtaaactattacagaaaatgtcttttggtgcttttaataagggctttgataagccaaatgaatggatttgcagtaacagccaagtagttgatgaatataataataatccgctgtgtaccttcacatttagtgtaaatggattttataatttattaagtttaatgcaaaatacatataaaaatatagattatgaagcaaataaaaaactaccagtcttatttatttctggcaaagaagatccttgcttgattaatgaaaaagcatttaataatgctgtaactcatttaaaaaaacaaggctatcaacatgtgatttcaattttatttgagcatatgcgccatgaaattctcaatgaaaaatataaggaaactgtgtattcaacgattacgacttttttagttgatacaatggaggaaaatgatgcgtaaaagatgtttattaataattgatgttcaaactgctttgacgagccagtatccagtagatgaaaataagatgatcgagcatattcgaaaactaatcagggtatgtcataatcaacatctcgaaatcgtctatgttcgtcatcatgatgaggaattgattttaaatagtgatggttggcaaatagattcacggattactccgagacaagatgataaaatttttgaaaaggaatataatagtgcatttaaaaatacaaatttagatgcatatttaaaatcacagggaattcaagatctgattatcgttggtatgcaaagtgaatattgtattgatactagtattaaagtagcatttgaattaggatatagagttattgttccaaaagatgctacaacgacttttgacaatgatataataagtggaaaagtgttaaagcaatatttagaagaaaagatttggaagaatcgatttgctcaagttatagaagttgatacattattaatgatgatagaatctaagttggattttaaatttagttatggtaaaacatcttttaaagatgcagctttaattcgccaagctgtatttgttgaagaacaaggctttgaaaaggagtttgataagcttgacaatactgcgtatcatctggtgatttataaggatgagcagccgattgcggttggacgaatgtattttaaagataagacaacaatgatcttaggaagaattgcagcgctcaaagaatatcgtgggcaaaaattaggaagtaaggttgtcactgctttagagaacaaagctcgagaattaggctgtcttgaaactgagttgtcagctcaacagcaggctcagaaattttatgaaaaattaggatataaacctgatggagatatgtattatgatgagtggtgcccgcatgttacaatgaaaaagatactttaaatcttctatcattgacttatttaataagttaactataattatgtaaaaagagggatagaagatgaatatgaaagataaaacaaagttatttaatataccaaattgcttatgttattttagaattttattaataccagtatttttatttgtgtattttaatgcacaatggcaacatcattatattattgcagcatttattcttgtgctttcaggtattagtgattgtttagatggttatattgcaagaaaatataatatgattacagattttggaaaattaattgatccgattgctgataaattaacacaatttacaattgcgattactttgttatttacatatcccttagcttgggtgttattaataataattgtattgaaagatggaatgttaggaattgttggattatatttatatgattatggcttaaaaataaaaggagcttcatggtgggggaaaattgcaacagcttatttttattttgttgtaataattcttattgggtatcacattcctgatacttttgctagtcagttaatgattatcactagcagtgcattaatgttattgtcatttgtgttatatgcaaaagaattgaaacaaatgattaaggaaaaggataagcttgtagatgaacaaaagagaaattaaagaagaatgttacttggatatgcttgaagatgagttaaatagtgtcgatgccgttttgaatcatattgaaaaagttgaaataaaagaaggtatctttgatgaacatgttatccaaaaagatttaattagagcatattttgatttagaattagcgttagcaagtttatgcattttacttagaaaaatgtctgaaaacttgtttattcatattgatgaggacatacgtcgggatattaatagtattattcattctaataaatttgaatatcatgatcatgatagaatttatgtatattcacaaaaaggtaaagaacctgtagatttaaataatttattacggtttgcacgttctatcctctaatcgacaaattcatttgattgcccttgctatgataatgggggtgattaaaatggactttagaaagaatgcgggaattgtattaattattttaggaatgattttaaccatggatcgaactaaagactttcaaggaatagtatcaacgattgcatactatataaaaggctactggcctttgattctctgttttattggaatgtacattttaagttcgccaaagaaaaagaaaaaatgaggcctagataaattctagacctttattttttaacctaatttttctactttataaccggctgcgcttaacgatgttattaatcctaaatcaccaacaacatgacctacaccaacgccgatgaaaacgactttattttgatttaaatattctattattttagcttgcatagtttggttacggtcaattattaataattgttgataattttgatattcttgttgatattcattatctggtagttcttgatagctgtatattgtcgctaatgtatcaagatcatgattataataactgtcaaggatcaattttgtacttttgattaattgttgtcgatcttttaaggattctaaaattgcgtgaggtgattctttagataattgtgaaaataattgcatctgaaattcaattccttccatttcttcaaaaggaatctttttacttctggtgagattaaaaaggtaagcatcaatggaagtgctattattgccatctacttcgtctagaatatcagaggttactaaagaacttactgccatagcattaaattcattaacacggtatttttttagtgtaggatagttttcttttaatttaggaatatagttaatcaaatctagttcacctaaactgttttctaaaagataattttgatatttagcagtttcattttgatctaatgaacattctaaaacaatactttgactatccttgattgctttttcggtagttatatcaagtttatcaatttgatcacgaccaggatgacaggttcctaatagataaagatagtgattattattgtcactaattttatagagatatggactgacatcaacagttttagtagttgctcttttatcaatactacaaccacacagcataaaaatgagtaataaacataataattttttcatagcatttcccctttattatttatattataattatataactatattatttatatatcaatatattatagaaatataaaactattttaactgaagagattttgttagtaaaaagttattaaatttagattatttcaagtatttcttgtttgattattgtagttaaacaagttataatggttcatgaaaatggaggaattagataatgaaaaaaagaccaattgtattatgtattttagatggatacggattaagtgaaagaattgatggaaatgcagttaaacttgcaaatacaccaaatatagatgatttagaaatgatttatccaacaacaagaattaaagcttctggaatgcctgtcggattacctgatggacaaatgggtaatagtgaagttggacatttaaatattggagctggaagaacagtttaccaatcattaactttaatcaataaagctgttgaagatggaacattctataagaatgctgaattcttaaaagcaattaataatgccaaagaaaataatactaaattacatatttggggattattatcaaatggtggagtgcattcttcaaatgaacatatctatgccttattaaaattagctaaacaagaaggtttagaaaaagtatatgtacacgcatttttagatggtcgtgacgttgctcctgatagtggtgctgattttgttaaagaattagcagataaaattgaagaaataggtgttggtgaaattgcaactgtatctggtagatattacgcaatggatcgtgataagaggtttgatcgtgttgaattagcgtttgatgctatcgttaatcataaaggtgaaagctttgaatgtcctgttcaatatgttaaagattcatatgctaaagaaacttatgatgaatttgtaattcctggatataataaaaatgttgatggacaagtagctgatggtgattcagttatctttgcaaactttagacctgaccgtgcgattcaattagcaacagtgatgactaatgatggattctatgaccatgcatttaataatgtgccaaaaaatttaacatttgtttgtatgatgaaatatgcagatagtgttaatggtgcgattgcttttgctttaccaagtttaactaatacacttggtgattatttatctgcaaaaggtatgaaacaattaagaattgcagaaactgaaaaatatgctcatgttactttcttctttgacggtggtgttgataaggaaattgaaggtgctactcgagtgttagtaaattcaccaaaagtagctacttatgatttacaaccagaaatgtcagcatatgaagtaaaagataaattaattgaagaattagataaagatattcacgatgttgttattgttaactttgcaaactgcgatatggttggacatacaggaattataccagcagcaattaaagctgtgagtgttgttgatgaatgtgtaggtgaagtatacaataaagttcttgaattaggtggaacaatgttaattactgctgaccacggtaatagtgaaatgttgttagatgaagataataacccatttacagcgcatactacaaatgaagtgcctttaattgtaacaaattctcatttagaattaaaagagggtggaaaattaggagatttagcgcctacgattttacaattattaggacttgaaattccagctgaaatggatggagaatctttacttaaataatgaaaaaattattaagtttaattgtatgtgtattaatgattagtggatgccaagacgcatccattaatcgtataaaaaaagacaatagtttatcaggtcttcatgaaattacttatgatgaattagaaaacaaattatctagtgatgatacttttgttttatatattggtcgtcctgattgcggagattgtaaagagtttcatccgattttaacatcgtatttagaggaaaataagggtacttatttatattatttaaatattcaggcatttcgtgatgctgccatgcaagagggggcatctgaaaaagaaattgatttttataaaaatattcgtgaggagttagattttaattggacaccaattttaaaattagttaataaaggtgaaacaattagcgagtatacttatctaagtgaagagtattatgaaataaaagatgatacaaaaaaagcccaggcaaaagaaaaatttgtggaagactttaagacctggatggcaaatatatatgagtaggtgattgcatgaaacaatgtccacattgtaaaaaaaatattcctgatagtgccaaagtttgtcctcattgtggtacacgcttagaaaaaggctatcaacccatgaaaagaacaaatacatttcctaattatttatacggtattttagctttagtattgattttctcaccgctgatttcatcaatgttatttggtaattttttaggtgacggaactgcaagtaatactgttactacaccggataaagcaattacactaggtccactaggtgaggttaatattaataaagaggtaacagaatatcagtttgggagtttaaaagattttgataaactagtaactaatagtgatagttatgttaagaagatcaagcagttagaaaatgatttaactgcaattactgataagtatggtaaaacaacgattgataaagattatgatttttatgtaactgatcaaaataatgtttatacaagtctgaattatgatttaaagattggtaaaaatgaaacaatgtcaattagtttttcatatgacttatcaggaacaactaatgctgttaatataggttatactattaacggctttaaagattttgaagctatgaaaatcaacgagcaaagttatccgatgttaaaagaaattgttaaattgattaacggtgatgatatgtatgtaagttttaataaagctggagagaagtttaatcaattagaaaatgattttaatgaacgaaatgaaagtattggtaattatggaataggaatcactcaatcagaagatgatacaaaagtgtcaatgagaattctttcaagcgaagatggttatcgattaaaaatcacatataaaactaaagctgatatgaataaattagtgggtaatagtaaaggaactgaataatcagttccttttttgctgtgctgcgcacgacataaaactaggtgatgaaagcccgttgtggaggtttcgtgctaccaaccaccagccaaagacaaggctgcaacataaactgttgtagtattattttttgaaaaagctaaatattaaatttggactatgttataatccttgataaggaagtggtgggaagatgaaaaagaaatatttaaaaattgataatatccctgcagttatctggggagcagggagttcaaaagtttttcttgcagttcatgggaataaatctaataaagaagatattgttatagaaatgctagcaaagacagcagtaaatagaggatatcaaatagttagttttgatttgccaaaacatggggatcgagtatatgaagatactttgtgtaatgcacaaaattgtacagaggaattattaaaggtatatgactatgttaaaggaaaatatgaaaagataagtttatgggcctgtagcttaggagcattttttagtttattagcttatcaatgtgttaaatttaatcagtgtttatttttatcaccagttgttgatatgcaacgtttaattgaaaatatgatgatttggtttgaaataaatgaagaaaaattaaaagaacaaaaaatgattgaaacacctattggggaaacattgtattatgactattattgctatgttaaagaacattcagtcaccgaatggaatagtcaaacaatgattttgtatggtgaaaatgacaatttatgtgaatatgaatatataaagaaatttgccagtcattttaattgtgatttaaaaatcatggaaaatggggaacacttttttcatctaaagaatcaactagagttttatcaaaattggttagaagagaaagttaaatgaggtgaaaaaatgaaaaaaatcgcagtattaacttctggcggtgatgctcctggaatgaatggagcaatcagagcaattgtcagagtaggaataaaacatggatttgaagtttatggagtatatgaaggctatcgaggattagtagagggtaaaatagcacgcttaggctatcgagatgtttctgaaattcttgcaaaaggaggtactattttagaatcatcacgtctaccggagtttactttagatgaagttcaagataaagcaataaacaatttaaaagaacatgaaatagatagtcttgttgtaataggaggtgatggcagttaccgtggggcacaagcgttagcaaaaaaaggtataaattgtattggaatacctggaactattgataatgatatcaatggtactgatgaaacgattggttttcatactgcattatgtaatattattgatgcagtaaataaattacgtgatacttcaagttctcatcatcgttgttttgtagttgaagtaatgggtaacaatgcagataatttagctctttatgcagctatatcttgtggaagtgaacttgttatcactaataagacaggctatgatgaagagcatgtaatcaaagagttgattaagaatgaaattgtttataataaacgccatgcaattgtaattgcaagtgaaaaaattttagatgttgaaaagctagcacaacgaatcagtgaagaaacaggattttcaggtcgctcgattgttttagggcatattcaacgaggcggctcaccggtgccggaagatcggatattagctgcaaggatggcaaataaagcgatagaacttcttcaagataatcaaagcggtaagtgtgtatgcctgcaagatggaaaaattgtggcgaaagatattgaaacagcgttacaagaagtaaataaaagtaatcaaatgctttatcagctctttgatgatttagtctaaactgttataatatggctatatattggaggattttatgaaaaaaatactattttgtgatatggacggaacaattattgatttagatgggttattatatcccccggataaagagaaagtggaaaagcttcaccaggctgggcacttgtttgcttttaatactgggagaaattatgaagaagcattacgcagtacaaacaaattagatttatattatgactatttagttttaaataatggagctcatattgttgatcgtaatgatcaagaattatttaaacgagttatttcaaaacaagctggtattgatatcatagaacattgtttgaaatatgatgatatgtggatatatttttatgatggaaaaaagacattagggtatttgagaggtcaaacatatatttatgatgaggtaggacgtagtattgtaacgaatgagcatgattttataaaagagtatccaaatgttgaggagtttgatataatagcgataaatcaagacaaccagcagattgatgaagttttaaagattcaaaaatatatagatgaacattatgcagatgaagcgcatggtacattaaatatgcattatttagacattacgccaagtggatgtacgaaaggaactggaattagcaatctagttagtttacttaatgaagatgttgtaagttatgcgattggggattcgtataacgatattagtatgtttgagcacgcggatcatggttacacttttaatcgagcggatgaactgattaaaaagcatagtgataaacaagtcgattatttatcggagttgattgatgaaatgcttaaataagggggaattatatgagttggcaagataaattgcgcgaggttgaaccatatgtagcaggggaacagcctaaaattgtgaatatgatcaagttaaatacaaatgagaatccttatggacctagtcctaaaattaaggaagtattaacatctttggatattgatcgtttaaggttatatccaaacagtgatgctgttgatttacgtaaagaattagctaattattatggacttgaagaagaacaagtatttttggggaatggttctgatgaggtacttgcgttgatttttttaacgttctttaatggaaaggaaccaattttattcccggatattacatattctttttatccggtatattgtgaattatatcaaatggcatataaactggttaaattagaccgtgatttcaaaattaatcttaatgattttatgcagcctaatagtggaattatttttccaaatcctaatgcgccaactggtttgttagttgatttagattttatagaaacaatattaaaaaataaccctgacagtattgtggtcattgatgaagcgtatattgattttggtggaactagttgtgtctctttaattgataaatatgataatctagttgtaacacaaacatattctaaatcacgttctttagctggaattagactaggaatagctttaggaagtaaagaggcaatcagacatttgtatgatgttaagaattcatttaattcttatccagttgattatgtcgcacaacaaatttgtttagcgagtatccttgacgatcaagatacaaaagcaaagtgtgctaaagtaattaaaacaagagaaatgactaaaacaagattaaaagaattaggttttattgtacctgacagttatgcaaattttgtttttgtaaaacatcctgatgttgaaggccaagaattatttacagcattgcggcaagtaggaataatcgttcgtcattggaatactaagcgaattgatcaatacttaagaattagtatcgggacagatgaagaaatggaaagaatgataaatttcttagaagaatatttaaataaataaaaatagatggcacgccatctatttttattatagctttttatatgtttgttttccatttctaatgtaaacataattatcgtctgttgataattcttcatgatatatatagccatcaaacgttagacgttttaagctatcaagatcactaatcttatttttaaccattaaatcaagcatttttccccgagcttgtttgacatacattgaattgcgtaccattttacctgctttatcttcaacaaagtcaatgtttatgatatggggatgtgatagcatcttagtaaattctttagaggctagggaaataatatagtcttcatttttaaaataattatcaatttcatcttgccaaaattgatataaattaaaatcaatcttcataatcatatctaaacgatatggggttattgcactattgtatttcaagatgccataataagccgataaaatatttaaatactgttctaagtatacaaaatcgtctgcatcatagtctttcaaactaagctgtttaaaaacagtaccttgatagcagtatagtgcaggaaccgcagtatattcattgtggaaataactatagacagtatccgccattttaaaagatattttcattatgtcatggagttgatcaagattaaatttcattaaataattatgtagctgtgtagtcttgtctttaaataagatatctgtagtttcaatatttacttgttttgttttcatcacctttgccggtgcgataataattttcattttaatcaccaagattattatatcgtatttcaacaaaatatgatatacttaaccgtggtgatgaaagaatgaataatacaattataattgataagattttgattcatatgttggatttggaacatagtaaaattatttactcagatacatttattaatttaactgaaggaacaactgagtattatgataaaaaaattgaaaaatgtttagaaaattctggaattaaagaattggtaaccggtagtgagcatcacttattacaagctggtaaaaaaatgattgaaagtaatgaggcgtttaaagaagaatcgattaaaataacgcaagatttatttgatttatgtacaaaaattgaagaaatgccaaatgctaatttaatgtttgtagaattaaaagtagatggtaagaaatttgttttaattattaagttaaactataaaactatgccaatgagtttaattgaagaaaatgatggtatacgtagtattagatttattaatcaacaaattttaccaaataaaacaacagctgttgaagaagcaattattatcaatgttgaagataatattttgtcgattattgaaaaacgttatatgattgatgggaaaccaggatattacttgaatgaacaatatattaaaggtgaaccaaaattaacagataaacaaaaaatgagtattgttaataaagttgtaaagaaagttgacagtgaatataatgttgttgaaggggatcccctaccattagtaaaaaaagaacttgttgatttagtaatggatcatcgtccggtaaaaccgatggaattggctaaaaaagttatgggaaacgactataatgcaactgaagaggttgaattaattatgcgcgatctgggaattgaagaagatgatgaaattgtcaacgttccagtatcgctagatcggatgtcacgttgtaaattagttttagatgatgatcgaattattgaattaaatgttgaggattatcttgaaggtgtagatatcgtcaaggaaatggatgagggcggtatgacgcgaatcatcttaaagaatattaaagatattgttgtgaaataaaaatgggttacggataacccatttttaaatagttacatatttattaatatatagataataaacgattgcctggatattagcttgtgggaaaacacgagctaatatttttttgtaataatccatttgcggcttatgtaaagaaatcagtatttctttactagtgtttttattcaaattatcagtcttataatcgataattgttatttgattatctttaatacagacaacatcaaaaattccatgaataatttgtccgttttcaagcatagaaaattctttttcacgataaagatagtcagcattaaccattaactgataaactgggctagtaataaagttttcaagatgttgttgatatttatcaattaattgccaggcttcattgtcataaaggtttgcttgtttgagtttatttaagttatctgataaatctaaatgaacgtcaatatcaagatgttcaagcacactatgaataattgttccacgtgttccagcatcaactggggaatcatcaagctcataacttatatccttaaaacttctatcgccatcttcaattttacgagttacagcaatggatttttctaggttagttgggtatggatattcaaaattactatatcgatgataactgcttaagtcaagaatagtatcacttttatttgaaacgataatttgttcttcaacatcatgatgactaagaatcttgatagaaaatttactatgtttagtattttcttgaattaaatgcttattttgatgaatcaaaatagtttgaaaattttgttttatttcattaacaagatcatctgtttgatcatggtctaggagttctttttttagaccttgattaataatattactgtgactcattaaagaaattcctaaccaatctaaatagctattttgcttacgtgcattatgataaagaattactttatctttacaacgtggatttatcattgaatcttcactattattaattacatatttttgccatttgataagatcttggggttccttaattaagccagtcataattagtttttgtgaagctctagtcaatgcaacataaaaaattcgcatttcttcgttgattgcttcactagtctgtgctgttgcaattacttttcgatatttattttcgtattcaacaataacgtcttgatagggttctaaatcacattttactcgcggtttgatcgcaattcctaattttttatcactaatgattcgttctcgggcatcttgctgattaaatttattttgcatattagaaacaaaaacaattggaaactccaatcctttagatttatggatagtcataaaagaaacaacattatcatcattacttgaaaccattgcgggagagagattgactccattattgatcatatcatcaaatttagtagttattgtatttaaagaatcatcatgcatttcatctaacttttgaatcattaattcaatatttgcaactcgttgaggaccattgactaatgaagctaagaaaggtaaataattactatcctcaaggaatttcatcaaactttctttaatagaatgactattaaaatagtttcgcatatcttgataataatttataaatgtttctaaagcttcataattatctaattttttttcaagataattaatacaattatcaaacattgagatagtttcatcaattttaatttgcgctaaaaaattctcactaaaatgacttattacataattgccctttagtaaacttgtaaaggcaatgtcatcaaggcgattattaaaagcttttaaaacattaacgagattaattatttctggagcttgtaaaaaaccttgagataaaacaatatgactaggaatattaaatttattaaatatctttttaaaagctataaagctgcgagtactacgcattaaaacaacaatatctttataatctgccagtctttttgtgccgttaaaattatccaattctaagtgaccaatcatatcctgaatttttttagcaacaatttttgcttctaattcagcatcattgcttatagtaccagtttgatatgataggatgacttcgctagtaaagcgtgcttcttcatcaagacgttgtgatgctttggcggtgacttctggcaaatcttctaattcttttgcaccttctttacgtaaaaaatcataattcaatttggcactttcatctaagtaataatcaagaccgccaatatccttatccatgatttgattaaaaatataattgacactgtcaaggacaattttatttgatcggtaattaaattttaagtcaatacgtttagttttaggtagtagattaaaagtaagatatttctcattaaaaatttccgggtcagcctctctaaaacgataaatcgattgtttcatatctccaaccataaagcgattgatcttgggttcatgaagatctgcaattttattaattagagtttcttgaatctgattagtatcttggtattcatcgatcatgatctcttttaattgttggtatagaagtgtaacaattccgtatttgggttctagtaattctaatgcattagcttcaagatcattgaaatctaaaagattatgagctagcttataatcttggtaggcctgtttaaactgttttaaataagtaattaatttttctaaaggctctaaagaggttgataaagttaatttaaactcatcaaaatcatcgtatacgatatcattaaatttatcgcgataaaatttgatgatattatttttaagacgattatattcttttttataaagttcattatcctcattaaataaacctctactatcataacttttcatcaaactagctttactagcggtaatgatattcgtcatgtttttactttctattgccttgatgacatcgaagtaatattttaaatgacaatcatatgggcttggtaaatctgctttcttaggcttatcaccaaagggattttgatagtaaaaagacaaattatgggaactggcataactagctaattcataaaccttattcaatcccatagtagcttgttgatgtagtagttcgataattttattactgataggccaattgtttatagcatcatcatcgttgttaataatgtgataataaatatcttttttgactgcatcaatataattatcaaagtcataaatagtattgcttaaattttcaaatttgaaaatagcgttcttaaagttgttaaaatagtattctggaaaataagtactgataaaatcaataaatgtttgatcttctgcccatgtttcaatacagttatcgagaatttggtgtttgatgagtgaaggatcagtgcaaatatcaaatttactattaaggttgatcaaatatccatattgtttcaaaagagtactgcaaaaaccatggaaattagtaatataagcttttggtaataattgcttttgctttaataaatgttgttccaatggcttattgatatcttcttgaagacgttcatctaatgcaacttgaagacgttgtttcatttcaagagcggctgcattagtaaaggttaagacaagcagttgatcgacattataaccatcatcttcaattaaagccatgattcgattaacaagaattttagttttccctgaaccagctggagctgaaacaagaatggaacatccgcgggttacgacagcttcatactgaccatcatttaaagaattaattggcatcgctattatcctcctcaagcaagtgttctaaattattactgtcaactaaagtatattcattatagaagacatcgaaattacatagactacgatagttacagtaagtacatggattaactttagtgaagaccgtagcatcatcactacctttaggattaattccaatatttccgtttgctaattcatgatataaattttcgatatgttgactaacataatcaattaaacgttcaaaagagaaactacttaaaatatttcctttgtaacagtcatcctttttaacaaattttgctttaatgattgctgaatctttatcaatattgttatcaacttcttcgactacttcactattaacataaccattcattcgatataatttgaaaaagttttcactaagttcagattcattgatttttaaagaactagtaaggattctttttttagtattaaagtataacaaagcacctttatcaagttttttttgttttgttaaagtatctaaatataagagcatttgaatattaaaaccttgaattgccaaagaaaggtcaaggtctttgttacttgacttataatcaataatctttaaatattgattatattgatctactcgatcaactataccgctaaatttaaaatcaggataattccgatagatatcaacttcactaccaacaatataaaaatcagatgctttcatttggttgataagaacgattacagtattaactagatcatgtttgaccgttttaataatatagttattagtaccgtaatttaagcgctcagttaaaccatgttcatttaaatattgctcgacatgttggttaataactgtttctaaatcatcgacttcagctttactagcagtaatattgtcagtaaagagggcttgagttttttcaagtacgtaatggatgatcgtaccaatttcatttatttgaaaaagcggttgtttaaaagggtataattttaatccatattgattaaaatatttgtatgggcaaccattgtaagtttccagcttacttgctgagagatgattcgaaaatagtggaacagttaatttatctggttggttattagtttgtatatagtgcttaatcattgtatttagtgatgataattcaatatccttaccaccatgtagatataaattggttttcaggctatagtgataatagtcattatttatatcaatatttgaaattttaaacatttgttttaattggttgtacaaagaagattttaatagcggttgaccatcaattgttccattactaaaacatattgctgtaaattcagtttggctgtttaagacttttagaatattattttgatcaacactaatttgatgatttaaatcaggtaattgtagaatttgatagtcttgatctagtaatattccagtatctttattttgttttggaacaacagtttcattgacaccaaccaaatagatttttttgcattctaagataccgctgtaacattgttgataatttaataaatataaatgatcattacatggtttgatatcttcttttaaagacggttttaattggtttactaaactataaaagtcggcaagtgtaaaggactggggacttgttaaattagtaaagaagtttattagcattgtctgattttgtgaaaaaagcatttcttgattaataaaattaatcattactgatgaataatcatctagtgattgcgctttttcaaagttatatagggtgctaaagggatcttcaatataacctttttcaagataatttttcttaatcaaatcaagatagtcaaagtcattatatcgacttaaaactttagtatccaataaatctaaaagatcattattatcatgatttaaacagtatctaatccataataaacaagcatccaattctttgaatattaagctttttttaatattatggggaatcttaaaattatttagagtatcaactaataaggttaaatattcttggttggggtaatagatagcataatcgtgatagtgcatgtgattatctacaatatcttgataaatatttaatactacactttcaatttgagcttttggtgtagtctgaataattgtatgtagtggtgtatgattttcatactttggtgatcgtaatgaaaataagtatttattgagatggctcaaataaggattatcattttcaaagacgtttttttgatcaccatgatatttattaaaaggtttattcaaatcacgtgaatcgctactattattaaccaaaattgttacatcattataaagtgatattttttttattagttcaaagcgacgttgtttgaaaatttgttcactaataaaaatataatgatcttcaacattagaattatcaatttgttcaaataatagttcttcatatttgtaacatgtattattaggtaatgaagtagttagctgctggtagagtccgataattgttgcaattttttgtttcgctagggggggcagctgctctaactctgaattactaaaactttcaagaaagaaaagatcgaaaatatcaatcaattcatagattaaatccattttactattagtattgaataagttattagaattttcaataagttgttttgttattaggattttatctaatttggatagttcttgataagagtatagttgataatgctctaataattttttgatcaaatcattgtatgtaatgatcctaatattaaaaagtgtatcagtatatttaaaaaaagcttcttcaaaatataatggatcgtcaacaataaaataataatttataaaaggatttttctgagcttgattaatgtgattgataattgtattttttatttttaaactatagtctaaaccatgtaatgttttcattggtaaacctccatatggaattattttatcatagataatagctctaatgcgaatgaaaaaagaaagtgaaatccgaaaatttcactataaactatttttttgataaattatctcagctttaccatagctggcgtagtaggcttggctgtcatcaaatgttggagctgagttttttataccagtaatctcactgtttattaattttaggcatagttgttcaagatctttcattaaaacaaaatctaacttattatatgcagaaatttttgactgaatttcttgttgattgtgtccaccccaaaaatgccaagtatcgtctactccttgtttttcaagatagtcaatagtctgctggagagcggtatgatacgtttttaaatcaaggctatggaataattgtagccaaacaccacagccggaaccaattgcatcaccagtgtaaatacacttattttgacggtctagaaaaatcattgatcccggggtgtgaccaggaagagcaaggacttctatttcaaagttaccaagctcaatttgctgatgattttttaaatctttgatttggctgaagtcaatcaaagaaagttccttaataatatgagcattatcataataaatatcacggtctcgatgagataaatagatagtttcttctttaaattctttgattgtgccaatatgatcaaagtgaccatgagtacatactataattaattctttattagtaatatttttaatcgtcggtaaaagtggttctttaaataggcctaaatcaattaatagagcatgggtatttcctattattagataacaagagtcaccatcctcatcattgatataatagctgtgattgttaatttttatggtattatatagtttcatatttaacctcgaagttctggtgcaacatcatatatgttttctaatgctattcttaattcttttttccagtcaaactgacctttttttatgcaccacattaattcataacctgtaaatgcatatgctgaagcttgatatagtatttcaggatcgttttgatttctaatttgtttggtggcttgacccttttttataattgcaatagcgatattggtcaaatgatctcgaaaatcaaaactaccacggtcttcttttaaattcataataaacatttgactacttaagtcatagccgagttttattgattcttccattaatgtttcaaaacagatcaataactgttgccaataattttctgccatgattatattagccgtattagcaacgattgcttctgtaatgtcatcataaaaatgtgctaaaatatcgtctttagattttatataggtataaaaagttggttttgtgattttacattctttacaaatatcgttgattgtaacattattatatccatgtttgaaaaacagttggtaagctgtttcaataataatatcttttgtaatctttgtcatcgtattcctcatttctaataattaagtataaatcatctagtaaaaaaagcaagtaatgtaatcataaatgtaaccctttacatttatgattattatgttatactttacttgagtaaaataaatattaccgaagtaaaggaggagaattatgaataaattatttgaaaaaagttatatcggtaaaatgaaattaaaaaatcggatcgtgatgggaccgatgggaacaactggtgaagcagatggggcatataatatcgatgcaattaattattttactgaaagggcaaagggaggtaccggcttaattataactggtgcaaatgttgtatccactaaatatgaacctcggccatgtacggaacttagtaattttcatcatgttgagcgtttgaatatgttagtagaaagatgtcataactatggcgctaaagtttgtgttcaagtatcaccaggattgggaagacaacaatttactgatccatttacaccaccatattcagctagtgattgtggggcgttttggtttcctgatttgaaatgtaagccatttacaaaagaagatataaaatatatcgttgaaaaggttggatatggtgcttctttagcaaaaatggcaggagcagatgcggtggaattacatgcttacggcggatatttattagatcaatttcattcaaaacagtggaatacacgtactgatgaatatggcggttcattagaaaatagaatgcgttttacgcttgaatgtattgccgcgattagaacaaatgtaggaccggattttccaattttagttaaatttactccggttcataaagttgagggatttagacaaattgatgaaggaattgctatggctaaaattcttgagggtgctgggattgaagcattacatgttgatgtaggatgttatgaggcttggtataaagctatttcaactgtttacaacgaagaaggacaccaattagatgtagttaaagcaattaaagaaaatgtatcattgccagtattggggcaaggaaagttatttgatccaaaaaaagcacaagaagtagtagcacaaggagttttggattatgttgttttaggtcatcaaatgcttgctgatccacattgggctaataaagtaaagcagggaaatacaatggatattgcaccatgcgttggctgtaatgaatgtttattagcaggtttttctggaaaacattattattgtgctgtaaatccactttgctatgcggaaaaagaattcgcactgccaaaagttgatggaattaaaaaatcagtactagttattggaggcggtccaggtggaatgtacgctgctatcacagcaagaaaacgtggatatgaagtcgacttatatgaaaaggaagaacgattagggggtacactttgggcggcaggaatgcctacctttaagcatgatgtcttgaaattgattacttatcttgaaagacaatgcttgaaaactggtgtgaatgtttatttaaatacagagtttacgctcaaagacgctaaaaaagattacgataaagttattctatcagcagggtcatcaccaatgatgccaccaattccgggaattgaaaaagcaggttttgtaagtgaatttttgactgaccgtaaagaagcaggaaaacaaatagtaattattggtgggggtctagcaggatgtgaggcagcatgttatcttaaagaaaatgcggaaacggtaactattattgaaatgcaggaagatattttatttggttgtgaccactgtttaaataatgatcaggcgttgagacaaatgcttcaagataataatattaataaaattacaaaagcaactgttactaaaattgaagataatcgagttacatatctccaagataatcaggagtatacaatcgtgtgtgatacaattatcaatgcagctggatttaaaccaaatgatcaattagaagatgctttagaggaaatttataatgatgttacagtgattggtgatgcaaaagcaccaagaaaaattttaacagcaattcatgaaggatatcatgcaattcgagttatggagtagagttcattgaactctactttatttttattgtataataatgtaatggaggaactattatgagtaaaaaaatattcttttttgatattgatgggactttagcagtaaaaaatattattcctgaagatacaaaagaagctttaagaaagttacaaaatctagggcattacgtttttatttgtaccggtagaccatatatttacgcaaaatatcattttgaaaaatatgttgatggttttatttgtgcaaatggtcgatatatcgtgtataaagaagaggtattattggatgaaccattgactaggaaacaggttagttattttgtggatagttttgataaattagaatgtggatataattttaatggcgttaatcttggctatgctcatggaattgattttaataagttagctgatatgcaaacagattacgaacatccatattttattgaagattttaaaacagaggagatcgatgcccacatgtttgatgttcattttaatgatcaagaacattatcaaaagattgtttcctatttacaagatacagtagttttaaatgagcactttggtcataattctgctgatgcaacaattattggttatgataaaggaattggaattaaaaaactattgacgattttaaaaatagaacgtgataatagctatgcttttggtgatggttttaatgatgtgtgtatgttcaaagtagttgggcatccaattgcaatgggaaatggtgttgatgtggcaaaagaagctagtgaatatattacaagtgatatttatgatggaggaatttataaagctctgcttcattatggaataattgaataaaaaagaaacccgattaaccgggtttcttctggttattaagctttaacagttacgttttgagcttgtggtccacgatcagattcgttgatatcgaattcaacaacttgaccttcttctaaagttttgaatccttcagcgttgattgctgagaaatgaacgaagatatcttttccatcttcatcatttgtaataaatccaaaccctttttcttgattaaaccattttactttacctgtactcattaatggtacctccttgaaagatgtgcaaaaaggaaatactctatgtaactctaaatcacaaatatcggattgcggcggtacataaaggtaatacaatcttctaatacttgtgatactttgaaaattatattgctacttttgctcttatattttaacataatcaaaaaaagaaatcaaatcctttatgtaaacgctttaataaattttattaacttcaaattaagatagctaataatttgttaacattggctataaaaagtgttaaaatatccttaataaaaataaggaggaaaaatatatgccatttatttcatttacaacaaatcataaattaacacttaggcaagaaaatgaaattgctaaaagaactggggagctgattacaatcttacctggtaaaaaagaagaaaatttaatgttacatttagaagataatcaaattatgtatttccgcggtgatgacattccttgcatgatgattgcggttaaattatataatacaattgattttgatgctaaaaagaaatttactgaagagttagtaaaaatgatcaaagaaacaacaaatattgaaattaatgatgtttatgtttcgtttgatgaatatccaaattggggtaaacaaggaacactgttccagtaatgggaaaaaagacgaaaattgcattaactggtagtttaactatgttggcagctggaattggtagtttattttatgctggtaattatttatataatttggcattaaataaacaggctaataaagacgcgatatttactaatccctcaacaaataatcaaatacccgataaagatagaaccgatataaataagaagggagatagtagcaatttttttgatactattcattatcaggatgtattcttagacagtgatgatggattaaaactgcatgcttatcaatttttgaattacgggcatgattatgtgattattgtccatggatatacatctgaaggtaaattgatgcatgcgagtgctaaacatttttatgagcaaggttacaatcttttgcttcctgatcttcgaggtcatgggcagagtgaaggtgactatattgcaatgggctggctcgatcgtttagacataattaactggatcaaatatttaattgataatgattcaaaagttaaaattatcctgtatggagtatctatgggagcggctacagtaatgaatgtaacaggggaaaaattgcctgtcaatgttattgctgctattgaagattgtggattcactagtacatgggagatgttttcctatcagctaaaagaaatgtataatttgccaagtcgaccatttttagatattgcaaatattgtgactcagattcgagccggttattcatttggcaaagctgaagcaatcgaacaagtgaaaaaatcaactacgccaacattatttattcatggcgataaggatcgttttgtcccttttaaaatgctcaatcaattatatcaaagtgctaattgtcctaaggaaaaattggtaatcaagggtgccggacatgctcaatgtgaaaaaattggtggtcaagtttattggagtaaaattgatagttttattagaaaatatcaagactaattaattaattagtcttttttattgtcataaatttgtcataaacatatacttttttgctggatagtgaaattaattttatgtatacaattttatacaccaaataattggtttttattatatttactaattttacatattttggaagataaagtaaaatatagagtatggagggttgaggaatgggagatattagtaatggaactcgcatattgctaacgcaatatttattaaaaagattaacagacgaagatcatgctttatcacgtgatgaactaattaaaagaattggtgggttaggaacgacgatttctagcaatacgattaaagcagatattgaatcaataaaatcttataataatttgataaaagattgtcaagatgagttgcttaccccttttatatgcaatgaaagtggtagtattaattatgcaacaaaacaaaaaaaaggtgcgtacgttgaaaagacatattatactgatgctcaattaattttattgacaaggttattaggtcgaggattacatttagaaagtcaaaatgattcaaaattattagaaaaagtattatcagatagttctttgtataaaataaatcattatcatttgttagataatatcaattcaacttatgaagataattgtattacagtgtatttagagcaaattattaaggctataaatacatttgcttgtctatcatttaaagaattggaatatagtgttgttgaaaacaaagttatagataggcctagtcataaaacaattttattatatccaactaatattgatataaaaaatgatcaagtatatttagttggttacctaataaatagtagtgaagattttgaattggcatattatcgaattgatcgcattgatcaattgaaaataactcgtacccctaaatatatccaagcaaagactgagtgttttaaggagcgaatctggttatctaatgatccgcttgatattggaaaagataatttgatcaacattgaattacgtgtgtatttaggaaatgagaatatttttgaagctttgtatcaacgatttaagggatgtacattcacagttgaacaattccgtcgatttgtaaatgtttcaattgaacgggttcctgatgataaaaagttagtcagtggctttttacaattagctaatcatgttgaggtttttaaaccgttggaattaagagataagataaaagaagaaattaatcaaatgtatttgatgtatcgcagttaaaaggaattcgtagaatttcttttttattttaaaaaagttgattatttttagagtctctttacattttttgaacaaatatgcaaattaattttgatatttatttaagttgatagttctattaatttttgtgtttacaaatgataactatatctatttttattagtaacgatattcacaattcccaaaccctaatattaaaatgaacagtgggttgaaaactaacaagccaagtccgaacattatgccttttccaaatgcaaaagaaagtttaaaactaataacaatgtgataaaagataataaagtacatattaataaggggaattaaaagaaatagaagccaaagtggtgaaagttttacaattcgacataatgcaatatcactataaattggaataaaagcactgattccccaacgtctagctttagtgaataaacgccatcgtgcaattatatttaagaggatgaaaataaatataaaaatagttgtagtgctgctagtggaatagctatactcaaagtagttcattgaaacctccttttcagaattaatttgaattaataacttgttgaaaactacataatcaatatattaacaagaaagtaccttccttacaataaggaagtgatctttattttatatagttataatttctgatgatttgcggttatgcaagaatattagtttcattttctgtaactaagtttcgtttgtaaacgtatacagaaagtggttggtttgttattcttggtttaggaggaagaaatatgagacaagtaaaaagatggattttacagataggaatttgttttacactattgttatctttgggtgtattctcaatgagtaatgtacatgctgttaatgagggaataactattactgataacacaaccggccttagtgaggcaaagtaccaagtaacctttgttgttgacagtacaaaattaggggaaaatgttgaaaatatccaattacaaggaggcttccaatttattaagagttctgaagctccctggtatcaagaaaacggggcaagcaatgatggaataaggtggtattcggcttatgaatatgagcagggaatgtatcctactggaggatgcggaaatactgaacgaactgagtttaattataatgaaaactatactctctatgatatggtaaaagatgaaaatttatattctgtcaccttaccattaccagcaacagaatatttttatggatattttgtaacttatagtgatggatctgcagtagttgtgcaggatcctgttaatccttcaaaaaagaatgaaattaataatcatgatgctacttggtcctatttttatgttggaaatagttcagatgcattagcgggtcaatcttatatttatccaagaaataataatatgggttcttatcaatacgatacatacatcgcttatgatggaactgaaaattgtcttgggatttatttaccgaatggttatagtttagggaataactataaaacgatttatttagcacatggtaatgggggcaacgaaactgaatggtgtcaattaggatcagcaggtaatattgttgataatctaattgctgaaggagaactagctgatagtataatcgtgacattaaataattcgcattttagcgggacaggatttgatattaaatcgaatgtcatattggctcaagatgttgttaataatgtaattccttttattgaaaagaattataaggtttcaactgatcctaaggatcgagcttatgctggattgtcagctggtggtgttgcggcaagtacagtaatggaaattgcacctgatagttttggatattttggtattatttcagcagctgttcaaattgatgatgaagtatttacagacgaacttatttcaaaattacagacaaagaaaatctatctttcggcaggaacagttgattttgggttgattaattctttttttaaggcctctatcttagattttatgttacctaaattagatgctgaaaatattgattatacttttgaaatacaaaatgggggacatgactggaatacgtggcgtggagcttttacaacatttgctaaagatatcctatggaatcaagaaaatattgaatattgtataacagatggagctaataaaaatattaaacagggagaagaacttaaaataaagactgacataccatcgtcattattcaaaatgctcataattgatgatcaagaaattgatagatcaaagtatactgtttctggtgatctaataaccattattttaccaaaagaacttatttcaacattaacaattggagaacatatattagtaataatcgccaatgagggacaagcagctacaatgtttaatattactgctgatactaatgttctagatatagtagagaatgatcagataactaaacaatcatcacatactgctgtgctggcacctaagacggatgatccttcgctgtttggagtttattgtctatttattttgttaagtgggggagcaatagttgtaataaagaaaaagtattttaattgatatgagtctaatattttgaagactcatattcttttatattatcaagatgttataatatagggaaaggagctgataaaaatggatgaggaaatactagaaagtttcttaacctttattcaaagatgtaacagcgaagctgttaatagtaatgattataatattattcaaaatgtatttaagtatattggaaaaaaaacattcccttctattaatgaattagctcgagaggcgaatgtatctaaggcaagtatttcaagatttataaaaaaatatagttttgaaaattatcagcaatttagaaccctattatcaactcaaacaacactcttagattataatttgaaagtatttttatcacagaatattctttttaaaagtaatgaagaaatcagtgaatatctttttcaacagtgtcttgataatcttgttgcaacaaaagagaatcttgatttagcaacgcttttaaaaattgttcagttatttaaggaaagcgaggatattacttttctaggtgatgagcatgatcttgatgaattccttttgttgcaaatcaaattattgacttcggggaagtgcgcatatctgtttaaagtcagtgaaacgaagacggttaggagctatttttttaatgaaaattcagttgttgttatcattaatgtatgtgacggtttttttcactaccatgatgcgttagaaaatgcaaaagaagttggggctaaggttatttatataagccaggattataataaagaggttgctgacaaggtagatattttttatcgttacggagtagagtggtcaataaatactggctatgtatcactgtattatattggtgagttactggaaaaattatgtattcgtaatttttagacaaataatttataatgatgtaagcagcctcaaaaaatataaccctaatactaagttataatgatagggtgtgcttatctaaccttatttagtattatttttaagatttgtgattattagatatataatcaattataattacattgaatagatttattttggttatctaggtatggctatagaagacctaatcattatttaggttgaaaataatttaatatcagtatttaatttttaatagaatttttggttgttttaaatcaaatcctttattttgaaagcgttgacaaattttgcgaggaatgataatataaatatgtaatttatggatagttattgcacatatgaggcaacactaaacctgtttacagatatttttctgtggcaggttttttatatttatacaggggtgaatgaatatgattataaagaaaattttaaataataatgttgttattacaactaactatcaaatggaggaaattattgttatggggaaaggcttggcttatggaaaacaagccggtgataatattgatatgaataagatcaataaaacttttgaagtaagtttaaaaccaagtcaaagaaaaatgattaatatgttaaaggatattcctctcgaatatatggagatatctgattgtgttatcaaagaagcaaaagtagacttagaagtcgatgattctctttatatcagtttaacagatcatattcatacaagcatagagcggtataaagaaggcgtttatttaaaaaatcatatgttatttgaaattaagaatttctatcctaaagaatttgagttaggtttattaactttaaaacttattaaagaaaaatatggaataaacatggaagaggatgaagcggcatttttagcattacatatagtgagtagtgaggttggtagaaatatcagtgatatttatgaaataacaaatttcatattagagattattggtattgtaaaagattattttaaattagagttggatgaagattctttatcttattatagatttgtaacacatttaaaattttttggattacgtgtttttaataaaataaagcaagtggaagatataaccttaaataatgacttgcttgaaattatgaaggaaaaatatgttgagtcatatctttgtacttcaaaaatacaatcgcatattgaaaagacttatcattatgaattaaatgatgaggaagttttatatcttacgattcatgttgcaaaaattatttctaaaaaataatttgcaaatagatatttgttggatggtaacattaagttggccaaaccttcacattttgaagttttcaaaagaatggaggaaaagagaatgaaatatgaaaaactttcaaaaaacattattgaagctgtaggagggagtaataatattgtaactttgcagcattgtatgacgcgtttgagatttactttaaaggatgaatcaaaagcaaatgatcaaaaaattgaagcaattgatggagttttgtcattaatcaagaaaggtggtcaatatcaggttgttattggtacacatgttcatgatgtgtatcttgatgtatgccagattgcaaatattaaagaagatgaaaattttggaaacaaaaaagaaaaaaaaggaatttttaattctattttttctgcaattattggctgcgtcggtccaattattcctattttagtaggaacagggctggggaaatgtattttattatttgtatcaatgatgggatgggcaaatgccgaaacatcaatgacttattatgtatttaattttgtatttgatgctggctttactttcttgccggtatttaccgcagtggcagctgcaaagcattttaaatgtaatatgtatatggcagctttacttggctgtgcgctggttcatccacaatggagtggtattgtttcagcgactgatccaaaatttattggagatatgtttggtttcttacctttatatggaatgccgtatacatcaactttaattccagctattttaattgtttttgttatgagcaaagtagaatttggattgaataaagtattgccagaattggttagagggatgttaacaccgttatttacattgctgattatgacaccgttagcatttgttgtattagcgccagctatggggattatttcaatttatttgggtaatgcattgttatggtgctatgatacatttggaatgtttgctattgcaattatgtgtattatttatccatggatggttgcaacgggtatgcatgctactctagcaattgcaggaattcagattttatcacaatcaggatatgacccattttcaagaactttaactttaacagcgaacatggcgcaaggtgctgctgcttttgcttgtgcggttaaaacaaaaaatagagattttaggaatacctgcttatctgccggatttactgctttctttgcaggaattacagagccatgtatctatggtgtgtcaattcgtttgaaaaagcctatgtatgcagttatgattggaagttttactggaggattatatgctggtttttgtggattaaaagcatttgctttcatgactcctagcattattaatttaccaatgtgggtaggggggaacaaccctaataatcttatgaatgctattattactatgattatttcagctgttgtaacgtttattgcaactttagttattggttttgatgatccgaaagaaagtgaagtaaaacacgatgataataaattaaatcaagtgaattgtcctgttaaagggaagattgttccattaaacgaagttaacgatgaaatgttttcaaaagaagttttagggaagggtgttgctattattcctgtagaaggaaaaatctatgctcctgctaatgggattataagtgcaacttttgaaacaaaacatgcaattggcttaacaactgaaaatggctctgaaattctaattcatgttggaattgataccgttaaattagaaggaaaaccatttattcaatatgttgaaaaaggtgagtatgtaaaagcggggtcattgttattagaatttgacttaaaaatgattaaagaagcgggcttagactatacaactatggttgttgtaacaaactctaatgattatttagaagttattccaacaaaattgaaaaaagtaacaaaaactgatccagttttaactattatttaaggatgtgataatatggtgtatgcagatttacatgttcacactgcttatagtgatggtattcattctattgaagaaacgatcaaattagctaaggaaaaaggaattaaagtgattgcaattactgatcatgatactgtttttcatttcaaagaagtgcaaaaggtatgccggcaaaatggtttagaaacaattcgtggggttgaaatgagctgttatgactacgatgtacacaaaaaggtgcatgttgttggtttggggttaaataaccatccgtatcatgttgaaaaactatgtcaaaagactttacaatgtagggatgagtatcatcatgaacttattaaaatattaaatcaaaagggcttaaatattacttacgaagacgctaaagaatacgctccgtataatattgtcttcaaaatgcatttattcttggcgattgttcataagtatcctgagtataatgatattaataagtatcgagaattgtttatgagcgagacttcgctagatgtagactctaaaatgggatatatcgatattaaagaggggataaaggcaattcgtgaggatggaggaattgctattattgcccatccttgtgaatataaaaattatgatgaaattgaaaaatatgtcagctatggcttacagggaattgaaatatcacatcctagtatggaatctgaagattattctttaacacaggaacttgcaaatagatttcatcttataagaagtggtggcagtgatttccataatatccatttaactgcaattggtgattttggattaactaaagagcaatttgatgaattgaaagaggaaatgggtagataagatgcgaatagttaatattaaaaattttagagatattaagggatatagctctcaagatggttttgtaataaaaccctacatgatttttaggggtggtgctttagataaattaactataaaagaacaaaatcattttgttgatcatttaaaaataaaatatattcttgattttagagatgaagctgaagcaagcttagcaccggataagcagcatgaaaatattttatatgaacgtatcagtgctcttaaaatgcaatcgcatgatcaatatggttttgattttggtactatgctgcaaggagagatgactaaagaaaaatacaactatctaatgtcttatatcaaagcaggatataaagagatggcttttaataatcctgcgtatcatcgcttgttcgaattgttattaagaaatgatggctatgtttattttcactgtactgctggaaaagataggactggagttgccggctttttgattatgattgctctaggaatgagtgaagaagatgcaatccaagaatacttgttatccaatatttatttaaaagaaagtaatgatgaattatgtcagcagctacaaattcctgagaaattaagggaggaatgtagacccttattatatgttcaaagagaattgattgaaataatgattcaatcaattcgggttaaatatagaagttatgatgaatttttattacaagaatataattttgataacgaaaaaagaagaagattgaaagaaatatattgtgaataggtggtgggaattttgccatttgatattaaattctatatagtaaatcatggaatatgggttataagaattatgattgctgcattttgcggctgtttgattggctatgaacgaagtagtcgaaataagggggcgggggtgcgtacacatgctatccttgctttggggtctgctttaataatgttagtatcaaaatatggttttatagacataaatgaaatagatggttctcgtatagctgcccaaatcgtaagcggcgttggttttttgggcgcaggcgttatttttgtaaagaatggtaatgtttcaggtttaacaactgctgctggaatgtgggcaacatctggagtaggaatgtgtattggtgcaggattatatgatatcggaattataacaacaattattttgataggattacagatattgtttcatagggggttctttttaaaggtcacacaaaataatcaaaacatacaaatggaaatctattatgaagattatgcattgaaagatattcgtgaagtttttgataaatatggtattgatatacattctatgaaagttgagaatctaaaaaataaatctatgtttttagaaatggagacttatgtgaataaagggtttcaaaaagaatcactagtagaagaaatgatgaataaaacatattttaaaatgttgaactattattagaagagagaaaatctcttcttttttatatattttaattgagataaaaataattaatgaaaactattttttgatttctgaatatatgcatgaatcggcttaaactggtgaaaattatatttaatgatttaaagattgaaatgttctttattttgaatcatcaagattttttaatacctatctagatagtactggcaaaaaatagtttccatttaaggaaactattttgattaaaaaaattgtattatctataatttaagtaaagagaggggaggatataaggcgatttataatagaactgatcaggtaattttaaatcaaatagtgcactccattttatacaatatttgtatgactctttttaaatgaatgacttggtgaaaaggaggaagtaagtatgcaagctttaaatagtttttttgaaagatattttatgccctttgcaacaaagcttaatagtattaaagggcttattgctattcgggatgcttttgttcaaatattccctcttacatttgtaggatcaattgttgtttgtattaatgttgttttattaagttcatcaggatttattggtcaatttcttgttaaaataattcctgatttagatgattttcaagcagttttatctcctgtaagtaacggaacaattaatctcatggctgtttttattgttttcttaattgcaagaaatatggcaaaacagtatgaagtagatggattaaaagctggattaactgctttagcttcattctttgtattatatccacctaaggttgatggaatgttaacggaatcttatctaggggcaaatggaatttttgttgctataattacagggttactagttggatatggttttagtaagttaacaaagatcgataaacttcaaattaagatgccggatcaggttccacctgaagtatcaaaatcatttatgattgctattcctaccgcaatcatcattattttaatctctgttattgcttattgtatttcgctgatagagcctcaaggattaaatgctttagtttatgcgattttacaagcccctattcagtctttaggagctacaccgtttacacctatgattcttatttttatggcaatgatcttatggtcagtaggaattcatggaacctttactgtttctccgatttatattactttatatgcttctatgaatattgctaatatttcttatgcagcacaggcaggaacaactgcgggctctccgtatccatatacatggtttgccttgtttgaaaactatggatgtattggtgggacgggtaatacattagcgttgattgttgctattttgattctttcgcgaaagaagggatggaaaagagctgattatacaaaaactgcaaagattggtcttattccaggattattttgtatcaatgaacctattatctttggtttgccaatcgtattaaatccaatccttgtaattccgtttatcttaagtccaattgtttcaatgggtctaggcgcattgatgatttctacaggacttgttttgcctggaacattagatgttggatggacaacaccacagcctattaaagcgtttttatcagcttcaggttcgtgggagactgctatttcagtttgttttgtatttataatttgtgttttgatttatttaccatttgttgccttggcgaataaacaacagactaatcaatagaaaggagttatgttatgagacgatttcctaatgattttttatggggtggtgcaacagctgctaatcaattagagggagcgtataatgaaggtggtaagggattgagtacagccgatatggtaaagtttgttcctagagaaataagctgtggcaaaaatacagaaactgttacttatgaagaagcaatagaaataatgaatggaaagcacgataatgaatattatcccaaaagatgggggattgatttttatcatcattataaagaagatattgctttaatggcagaaatgggatttagatgcttccgtatgtcaatcaattggacaagaatatttccaaacggggaagaacaagagccaaatgaagagggattaaggttttatgataatgtgtttgatgaatgtttaaaatatgggattgagccgctagttacattgtcgcattatgaaacccctctccagcttgctttaaagtataatggatgggaaaataggaaaatgattgaattctttgttcattatgcggtaacagttttcaaacgctatcgaaataaagtaaaatattggataccttttaatgaaatcaatatgtctttgcatttaccttatacaggcggtgctattttcattgaaaaatcacaaaatgaattagaaactatttttcaagctttgcatcatcaatttattgctagtgcgttagtagcaaaaaaagcacgggaaattaatcttaattttcaaataggatcaatgttaggtatgtctttatattatccaaagacaaataatccagaggatattttggctgctcaatgggcaaatcgtgtaaattattttttcttagatttattatcaaaaggtgaatatcctgaatatgcactttcttatatgaagaaaaaaaatattgaattgaagatgatggaagaagacttatcgctgcttagagagaacacagtcgattttaattcttttagctattattattctttatgtacgtctgcacatcctgaaaatgaagaagggctgattgcttttgttcctgaaaatgaaattattgatgaatttcttccaagaaaagttcgtaatgaaaatttagaagttacagattggggcttccaaattgatccaattggactaagggtggctattaatgaggtatgggatcgctatcataaagctattattgtttcagaaaatggcttaggcacatatgatactctgacaatagataagaaaatccatgatgattatcgtattaaatatctaaaagaacatattcagcaaatgaagatttgtatagatgaaggagttaaagttattgggtatacgtcatggggatgtattgatattgtcagtgcagggacttctgagcgcagtaaacgatatggatatatttatgttgatagtgacgattacggtcatgggagcatgaaaagatataaaaaagattctttctattggtatcaaaaagttatcaaaactaatggagaagatcttggttagtagtttaaactgaaaactcttactatgtatgagtaagagtttttcgtgtataataaaaaaaaggggatggctattatgatggttgataaattaaatgatgttcttaatcatgttgaaacatatactacgatgtatgtgttttgttcttataccaaatcccatattcatgatatcgcggatatgactatcgaagaggtcgcaaaagcttgccatacctctaaaggacagatttcaaaatgtgctaaaaatcttggctttacttcttatttagagtttaaagacgcttgtattgattatatacattcttttcaagataaaccgtcattcttttcaaaagaatgtgatcttcctcaaaatacaaaaatgtttgctcagtctatgtcaaaaacaattacatatgtaggggagaagattaattattcacatcttaatcgtctgattaacgatattttaagaagtaaaaaggtttatctatatgctcaaggagataatcgttctctctgtaatgttattcaagtagaattaagtactctatatattccggttgtaatttgtgatgcagatttcataaaatcatatcagtttaaagaagagcatcttttgattattttaagtactaatgggactatttttcagctgaacaaaagaatcatttcacgtttagttcatgcagaagttaatacttggctaattacttgcaactgtgatattgagttttctaaaaataagcttatagttccttcgtgtaaagcaaaatataataaatatgcaattaggcatgtgatagatattgtgattgcagcaatgcgctttgttcagcagttataaattgataaaagctgagttttatcttaactataaaacttatgtaactgttaaagacagctgatcatgtcacagtgaaataaaaaacagtgaaagttttattgtggtaaaatattgcgtttttaaattaagcaagctgcgattattaattaaaacgcaaagacttttttgtaaactctcactattaatatcttttatttatttttccatttttttgaaaaatccgaattttcagattcattatgtcctctatgtccaaagacttgatgttgagctaatgctttttctagttttttaaattcttcgttgctcaaagttatagaagaggcctgtagattttctatgattctatctttgttttttgaatcaggaataggtacaacattaggatatttatgcaacatccatgctaatgaaatttgagctggtgttgcttctttctcttttgcaaactgatgaagtatatctataataggttgatttttaacaatgttttcttgtgtaagctgtggaacaaactttcttacatcatcaccctcaaattttgtttctgaagttacttttcctgatagtagtccacttgcaattggagagaaggcgacaacaccaatctgattatctagacaatatggaaaaacatcgtcttcacagtctctttctaataatgaatataaattttgtactgctgtaactggtgtgagttcatgggctttttgtatcgtttcttttgtaacttgtgaaaggccccatcctctaatttgcttttcttgaattaactttcccatcactaatgcaacatcttcaataggaatatcgcgatttattctatgtaaataataaagatcgatataatctgtttttaaatttttcattgatttttttaagtgctctcgaataactttctctaatccattattttcaacttcttgggtatttagatataatttggttgcaagagttatactataaaaaatgtagggtcctttacactttttatagttttttttgtgttagtagttatagtttcgttctagttattttattatcgattgttgaactctataaacttgttagtatgtcctgtttagatgatttgtgttcttttcgataagaagatggagattttccggtctttagtttaaagtttttgatgaaatagctgctattactaaatccggttttatatgcaatttctgtgattgattcatcagtttgtaataaaagcttagttgccatgattaaacgataattcataagatagttaaaaatggtataacccataacttttttaaattccttacagcaaatactctttgataatccaacgatattagctatttcatcaagctgaataggttcagcataatgattgttaatataatccataataacccttaccctcaattgatgataagattccaattcgtttttataatccttaaaataattacttaccattaaattccaaattctaaggagattaatcaaaatatcaagttcatgattagattcattatagtagacataaatttcttgtaatagttcaagaatcattttttgccaatttttattatttttaaagatacaatattcaagagagctgttattgagatatggatcaataaaacggctgttaattaagctgccttgaaagctggaaataaactggctatgaaaatcaagacagatataagaactatcaatattttgataattaacagcttgatgtagctgtttagtgttgatgaatataccttctttttcatttaaaataaacgttttttgatttactgagaactgaactgatccatgtgttatataacataactgtagttcgttatgccagtgccagtcaatgaatcctaatatatttttactaatctgagttgtataaataattagagggaattcaaaggaaccatgttgtgtgatttcttttttatttttattgatttgtatatcatatgtctgcataaagttttctccttcattagataatatagttatattatttgataatattattatatcaatacaatgataatgtcaatataattatattaagaaaggaggaaaaatatggcttatcaaattcaaaaaaataatttacacaattacagaaacaactataattttgatattaatttcaatcaagtttttgcttttcatcattcgcttagtcagtattatccaacaccattacataatctaaatggactggccaaattaagaaaagtaaaaagaatttatgttaaagatgaatcttgtcggtttaatcttaatgcctttaaaggattaggtgtgagttatgcgatgaataaggttcttgaaaaaaacacttctcctgtcgtctttgtgacagccactgacgggaatcatggacgagcagttgcatggtatgctaaatatacaggtaatgatgctataatttttatgcctcatggaagtgaacaaagacgtgttaaagcaattgaagaaatgggagcacggacttttgttttagatttaaattatgacgatacggtcagatatgcagataagtatgctagtgaaaataattatgtttttcttcaggatacagcaacagaagataatgaagagaatgtcagaaatattatcttaggctattcaacgttagtagaagaggcattatcgtttatggatgaaaaacctactcatgtttttgtacaagctggtgttggatcacttgcgggcggagtaatctggtatctttcaaatcgctatagaggtaaagtgccttatataggagtcatcgaatcatcagcgtgcccttgtatatatgaatcagttgtaaaaaagagtacattttttatagaggggatgcctaaaacaattatggctggattaaattgtggggaacctaattatatgacgttgccattgattgatgcttatgcttcgtgggtaattcaatgtgatgatgatataactattaggggtatggaattagcaagacatccagtttgtagagatccagctttttcatcaggcgaatcaggagcagttggactaggttttatagatatggtgttacagaacaaacaggaaagagataaactcaaaattgatgaaaattcgatcatattattattcagtacagaaggagaattgagaaatgaatgaaaatgaaaatctaattaaatttgcgcagagactggtgcaaacacgcagctattctgatgaggaaggtaatgtagctactcttgcaaaaaaagaaatggaaaagttgggctatgaagtttttattgatagattgggaaacgttgtaggaaaactaggaagtggtgaaacgattattcattttgattcacatatggatactgtacaggttaatgatccggaaaactggaaatatgatccttttgggggagaaattgtagatggtaatctttggggcaggggtagtgttgatatgaaatcatcctttgcagcaagtgtttatggtgttaaagaggcttatgatgcagggtatcttaaagataaaaccgtttacgtgactggctcagtatgcgaagaatactgtgatggagttaatttgattcacttgtacaaagatttgaatataaaaccagactattgcattatttgtgagccaagtgacaatgtaattactttagggcacaaaggtaaagcacaaattcgtattactacgaagggtatttccgcccatggaagtgcccctgaaaaagggaaaaatgcagtttatgaaatggcggaaattattcaaagagtggaaaagttgaatgcttctttatataaagaaggggctcatggaacagttgttctatctgaaatcacatgcattagtgcatctcttaatgctgttcctagctcttgttcaatttatttggacagaagattgtgtttaggagaaacattggaacaggtaaaagaagaaatggatactttaatcgaaggaaaaaatgcttcttgggaagtgggaacattaactcatactacgtggaaaggtgaaaaaatagtttataatccaatgcatgacccttggattattgataaaaatcatccattaactcaagcaatgattgatgcatattcagaagtttataatcaggttcctcaaaactttgacttttgggattttggaacaaatgcaattactcccgttgctttgggtattccaacaataggttttggtgcaggtgagtataaactagcccacatgacaaatgaacattgttcagttgataggatatgtgaagcggcttcggtatatacgcagctgttaaaatttttagagaaaggagactaaaactaatcatgaaacacaaaatatgcaaagattttttatggggttcagcaacggcagcttatcaatgcgaaggagcttggaacgaaggtggcaaagggaacaatcaatgggatgtatttgtccatagtaaagcaaatgaaacaggaatcactggtgatatatcatgcgatttctatcatcgctataaagaggacttaaggatattgaaagaaggtggccaaaacacttttagaatgtctctttcatggtcaagaattttgccagatgcttcaggcaaagtcaatgaagcagggattaaattttatcgtgatgtctttgatgagtgtagaaaactaggtattgaaccatttgtgacactgttccattatgatataccagaatatcttgtacaaattggtggctttgaaaaccgtaatatggtttttgaatttgaaaagtatgcaaaaatttgttttgaagcttttcacgatcaggttaaattatggatgacaatcaatgagccggcatattatacatactgtggttatttagcggcaaactatcctccatttgttgcggatttccaaagatatgtcaatgcctcatatcatgttattttggctagtgctttagctgtaaatgctttccatgaaactggttatgaagggcagatcggaattgtacaggatagctgttatgctcagacaccttttaatgatccggaaaaccttgcagcattaagaaaagccgatcttttctataacagatggattcttgatactagtattttaggagtatttccacatgatttaaaagatgtgctactagaaaagaatattgatttatcagttgtcaaagagggtgatttggatatttttagacaaggaaaaattgatattcttggtcaaaacgtctatacacgaaaaaatgttcaggtcaacaaagatggtattactctgttcaatgtcaataggaaaggaaaagaatcgaatattaaagaaggtacatcgattggtggctggtttgagactattgttgatccaactgttgagagaaatacatggggtagagaaatatatcccaaatgcatgtatgatactttaataggattaaaaaatgattatggcgatatacctgtttatattacagaaaacggtcatggaagttatgaaacaccagatgagaacggctatgtcgaagatgaagaaagaattagaatattgggcatgtttttagattatatggttcaggctattgatgagggggcaaatgtcaaaggatattatttatggtcaacgatggatctttacagctggattaatggttatgaaaaacgttatgggctggttagagttgactatgaagataatttaaaacgtataccaaaaaagagctattactggtatcgagattatatcaaaaaaataatgaacgagagttaggggaagaaaataatgaaagcagtgttagaaaaattacaatcatttttggatacacatttaatgccaattgctggtaggcttggaacagaaagacatttacatgccatgcaaagtacattccaatcaattattcctataattatgattggagcatttactatgattattagtaatccggttgttaattatgaaaaaattagtgcatcaacgtttggttacggatttttcaaagcatgggcggaatttgccaatacctatggtggtccaatacaatttttaagtacagttactttagggttcgtggctttatatgttactctaggtatcggttattttatggcagaagatttaaaattgaacaaatttattgctttagcaatggtttttattaattttatgatgattaacagtttctcagttgatggaggcatctcaacagattattttggtggatatggtatctttttaggaatggttgttgccatgtttacagtggaattatacagtttcttaattaagaaaaatatcgggcgtgttcgtttgccggatacagtacctggtgctttagtagattctttaagttcaattattcctatgattattatctttgctattccgactgctattgttatgattctatcaattggatttaatactagttttccggcattggtaatgcttatcatgacaccatttgtttcggcaacagataacttacttggatttatgattttaactattattgcacaattagtattcttcgtaggaattcataatgatacaatctggaatattatgcaaccggtattttatgctaatattgcgattaatgcagaagcttttgcaaatggtgcagctgcaactgaattaccaaaaatcattactcatccatttatgtggaacttctgtgttattggtggagctggagcgacattaggattatgcattctattgctttttagtaaaaataagcagtttaagacaatagggcgtttatcaattgtacctgcattctttggagttaacgaaccaattttgtttggtttaccaattgttttaaatccaattatgttgattccatttattgtagctcaagttgctaatgttataattgcttatggcagtatgtattttggtttagtcaatagaacaatcaattatgttggttcacaagcaccaaatatttatagccagattatttctacaatggatttcaaggctgttattctatttgtaatgttagttatattggatgcattgatttattatcctttcttaaaatcatatgaaaagcaacaaaataaattagaaacagcagaataattatataaaaatgagattaatttacatattgtatataactatgttaaaaacgaattaaatttaataggctgcaacgtttaagtatttttgactattttaagagtgttgcggcttttttttgtagataatttaagttatttcataattaaaatatttttttgatcaacgttcctattgttttatattaaaataaaatttttaatatgtcgttgacatgagtatgaaatcatactcaaaggagcggtagcatgcaatttacacaaaataaaactttacaagaatttgatcgtctaaataggttagtaaatgaactgtatcacgaaattgctgtcaaacaaggtatatccgatagtgcgtattctatattgcaagcaatgcttattttgggaaacggtaatacacaaaccgatatttgtaaatatacttgtttaaacaagcaaacggtcaactcctctgtaaaaaaattaaaacaaaatggattgattgaatttcatcaaggaaatggtagaaaaatgaaaatctatttgacttctaaaggtaaagattttataaatgaaaacattttgcctattgaacaggctgaaaatgaggtttttgatgaaatgactatccaagaacaacgggaaattttacgcttgattgaaaattatttaagttctttccgtcataaaatcgacaaattacaaggagaaaaataatgatacacaatatgctcagcacttttggtttaggcattcttggtattgaccccataacagcagtttatcttttatctatgggattacgcaacgaaaagaaaacaaaaatcactttattttttctatcttttgcagggttcagcatttttgtcggtgcagggcttgctacgattttaggtgtagctgcaatagattttttaaagagtgtaacgccaagtgatgatagtcccctatgggcaattttagaatttgctatctctatttttattctgatgtggatttcaaaaaaattgttcatagataaaaagcaaactgaaaatcagacaaaagaaaccgttaatggaaatgctttaaaacatattattacgggttttgtgtttgcaatcagttcttttacagaccctacattttatgcggtggtgcttataagtggcgaaacagataatatttttatctccattctgcttttaaccatttggtttttagtcagtcagtgcttggcagtgattgtatatattgcaaatcaatgcaatcttctgaataagctggtttatcaggttgataaattcaaaaacagaaatctaaaaggggttaaaaaggttttttatatcattctgattgtcattgccatcttgctaataattgatacgggattttatttgtttaatgatagatatctattttaaataataaattctttttattttaaaaatctaagttattaaactttcataaaaaattttttaagagattaatgatattatgtttgtatccacaagatacttaatagtcttttataatatggaataagttactgaaagtattaatgagggattgtaccactaaaaatatctggataggttacactgaattggagagcttttaggagaatttttatgaaaaaaaaagaaatgaggtaacctaaaataataagaggcataagaaataatattgataaatttagacaaaaaatgatggaattatacaacaacggtaaatcaagaactaagcttgttcgtaaatatgaactcactccttttgctctatcttcatggagcagatagttttatctttttaataacaattccccaataagtagttgcgaatactaacagtgaagagttgattcttttggtatattgtatatttaatagtgaaagaagacaaagaagactatagatgcaggatatactccgtatagcagttgtattaattaaatatgaaaaccttaatttgtcagttaaaagtaaataattaatgtttaagtgtgtagttcgttgaattacgcacttttaaattttataatcgttttagaatcagtttaattattaatgatgtgttaataattaaattaaaggcagttgaggtgagaatgttgagtgaaggaaacaggatatatatggctattgcaacactttttttgagattctccagctagaaccctggcaactaaagcgtatctttcttccacagtatactcagtgcaggtggtaggatgttttaaagcatctattccatgtaagtcagcgattttgacccatgtagtaattctttttccaaagtttttttgtccaattccttctggtgtttcatgccatcgaccatttttatatagttcaacacaattcaacttaaatccataatcatatttcatataaaaaccctccttactggtttgtccagtaaagagggtacgcatcattgcccaaacagaggggttcactacatattaggaggatgtttttatattaattttatttttcttcagtaataaacattttgtaaatagcacgaattgcatttttgaaatgaatattttttacaccaacaataatatttaattctgatgaaccttgatcaatcatttttatgttaatattttcttgagccagggctgtgaagattttagcagcagttccacgaccatctttcattccgcgcccaacaattgcaattaatgctagatcagattctaattcaattgaatctggttgaactgcacgatgaataccggctaaaatttcctgctctttatcaataaaagattcagtctcaacgacaattgtcattgtatcaattcctgaaggagtatgttcaaatgataaatcattatcttctaatacttgtagtactttacgaccaaaaccaatttcactattcatcatatctttttcaatcatgattgtagcaaatccctttttaccggcgattccggtaataacatgatctggtttatgacaagttgtttcaacgatcaatgttccttcatcttcaggacgattagtattttttatttgaattggaattccttcattacgaattgggaaaatagaattctcatgaagaacacttgctcccatataagataattcacgtaattctttgtatgtaattgtaccaatagtatcaggatctttaacaattcgcggatcagcaatcaagaaaccagaaacatcagtccagttttcatataaatcaacatgaccatttcttgcaacgattgaaccagttacatcacttcctccacgggaaaatgttttgattgttttgctgccatcattagcagaaccataaaaacctggaataacggcatttttaacgttacttaaacgtttagataaaactggatcagtcatttcttgatcataattaccatgttcatcaataaagataacttcactagcatcaataaattcaaaaccaagatagttagctaatacaattccatttaagtattccccacggctagcggcataatcaattccaattttatcttgaaaagctttcttaataatttcaaattctttttctaaagaacaatttaattttaattcgtcaataatatcttgataacgagctttaattaatttaaatgtttcttcaaaagtcttattatctttagcattataagcttgatataataggtcagtcactttgatatcatctttaaatctttttcccggtgcggatggtaccacgaaacgacgagatttatcacttttgataatattagctacttttttaaattgagttgcatcagctaaagatgaacccccaaatttaacaattttattcatactgttcccctttatataaatgtttaataaaaaaataccattttttagtggttacatcaagaaatatttaagaaaatgataaaataaatgaacttgtcaaagtattttcatgaattgaaatatttttcagatgatgaaaggactaattagagataaggatgatacggtataatgataaatatattaaggaggaataagaaaaaatgagttttcctaaaggatttttatggggtggcgcaacagctgccaatcaatttgaaggtgcatataatgaagatggtaaaggactaagtactgctgatgtaatgactaatggaacgcatcaagaagctcgtagaattacatacacgatgcctgatggaagtaaacatagtcaagcagtaatgccatttaaatcacttcctgatggtgcggtattagaatgtcatgaaggtgaatattatccttcacatcaagcaattgatttttatcatcattatcaagaagatattaaattatttgctgaaatgggttttaactgttttagattatcaatcaactggggaagaatctttcctaatggtgatgatgaaacaccaaatgaaaaaggactagaattttatgatcgagtttttgatgaatgtttaaaatatggaattgaaccggtagtaacaatttctcattatgaaacaccattaaatttagcaaataaatatggtggatggttagatcgtcgcttagtaggcttttttgaaaaatattgtgaaactatttttaagcgttataaagataaagttaaatattggatgacttttaatgaaattaatattatggattttatgccaccgtttgcaggtggagtcttaaaaaatgatccacaaagccgtgctcaagccgtgtatcatcaatttatcgcaagtgcaaaggttgtaatcatggggcacaaaattaatcctgatttcaagattgggatgatgacagcttatggatcaacatatgccttaacatgtaatcctgatgatgaattaaaattaatgttatctgaccaacaaagacatttctttagtgatgttcaatgtcgtggtttttatccagcttataaattaaaagaatttgagcgtgatggagttaaattgattaaagaacctggtgatgatgagattttaaaagaaggaacagttgactatattggattttcatattattcaagctctgtagtcactactgatgaaagtaaaaaagtaacggatggaaacatgtctacttcagtacttaatccttatttaaaggcaagtgattggggttggcaaattgatccaactggcttaagattagctttaaacaggttacaagaacgctataacttacctttatttattgttgaaaatgggctgggagctattgataaagttgaagcagacggctcaatcaatgatgattatcgtattgattatttagctaaacatattgctgcaatgaaagatgcggttgaatatgatggtgttaatttaatgggctttactccatggggatgtattgatttagtttcagctggaactggagaaatgcgcaagcgttatggtttcatctatgttgataaggatgatgatggtaaaggaccactaacaagaatgaaaaagaaaagtttttattggtatcaaaaagtaattaaatcaaatggagaagatttaagtaatcaataatttaataattcttggtattgtgttacatttgtaacatatatcaaggattttttaaaattaatttttcatttaaaatgataaataataaatgagcagattgaaatttattatagttataaaattatgagggtgatttaaaagctatattaattatgctgttcataatttaaaagcgctgatgtcttctatgtaggattattgaataccgggattgcccaaaaaatgtattgaaacacatagtatagtgatgaaatagaggtaacttctatccttaatcaaaaaatattctttacaattgacttatataaataaaagggaatgataatgattatatttcattatcattcccttttagtatttttggctacttttatattttaacatattcggcaaacaaaaacattaaatatttaatgttttctttttgtgcaaaaaatattttttgtatagacaaaagtggtatgatattaataaagaagtcataacataaggaggataaaaagttatgaagaagttagggaaagcgatacttggcttagctttagcactgtcgatgtgctttagtatgttcattccagtgtatgctgaaggggaaacagtagatacactagttggcagtttaatcggttattatcgagatggtgctagaacagacgttttgagaactttggatactttaaaagaggtttctaaagatgattatgatcaatggcaatcaatcattgattattgggactggattgaaaacgatatggtcgaaaatattggtgtagctcctgatggtctaccaaatgataatacccatgcttttgttgtactaggttttgcattaaagagtgatggaacaatgcagccagaattagtaggacgattagagactgctttggccagtgctcaaaaatatcctaattcatatattttagtaactggtggtgtaaagaaaaacggttggactgaaggggaccggatgcacgactggttagttgaacatggtgtagcagataatcgaattctagttgaaaataaatcagctaatacagcacagaatgctgaatttagttttgatattctttataatcatccaacaattaagagtatttctatgattactagccaatatcatttaaaacgtggaacaatcttatactatgcggaatcattaattcgagcacgtgagttagggaagacgccaattaaattaaatggtaatgcaggatggtaccgggaagataaaactagtgaaacattatcacaaaaagctagcagtttatcacaaattgctggagtttctattccttatggtgaaaaattaccaaaatctaaattaacaggaattgaagttactggtaaaaatacttatactgttggagatgcattagatatcatagttacttcaacttatgatactgaatatagtcgtgatgttacaggtcttgctaaaattattggatttgatgctaataaagtcggtaaacaaaatgtagttgtagtttatacggaaactttacatcattctacaagtagttctgaagatgtaactatgacagctgaatttgaagttgaggtaaaaacagctccaattacagttccagtaaacccacagccaaccccagataaacctgtaaatgcagtaaatactggagataacagcccattggcaataatgacgatggtagcagggttagcagctgctggaatgtttttagcaaaaagaaaagaaaattaatagctatagtgaaagctgaatcgcaaaatgattcagctttttttagtatatcaatgataatggaattaagttttatttattgaataatatttgtttgaccgtaatcttaaaatattgtaagattatattaataagacgggaactgcccgtcattttctttaggttagaggttataattatgaaagataaaaaattaacaatgagtgatattgcaaaaatggctggtgttggcaagagtacagtatcacggtattttaatggtggttatatcaaagaagaaacgcgtttaaaattaaaaaaagtaattgatgaaaataattatgaaccgagcacattagcgcaatcattgaaagcaaaatatactaaggtgattggtattgtagtaccttgtcttgattcaattacaacatctcgtgttttgatgacgatggatcagtatttaaaagatcatggttatacaactttaataataaataccaatcatgatgaaatgcgagaattaacttcgattgaacagctatggcgaatgaatgttgatggaattattttaatggcaacggcagtaacgatggcacatcaaaatattgctgcaaaattagatattccactattatttgtggcacagcgttatggagcaggagtctctatcattaatgatgattatagtgctggatatgaagttggaaaatatgcagcatatatggggcatcgtaagatttgttatatcggtgtaagtggtaaggatgaggctgtaggaatttatcgtaaagatggtgtgatcaatggtttaagggacaacggagtaagcagcattgatttattagaaactgatttttcattagaaaaggctcatcttattgctcttgattatctaaaaaagaaacagccaactctatttatcggagcaactgataatatcgctttggggtgtttaaaagcaattaatgagttaaaattaaagatgcctgatgacatttctttaattggttttgggggttatgagacttctcaatttattaatcccagtctttcgacagttagatttaataatgaagaaactggaattaaagcaggtcaaacaatcattgatttaattgaagggaatgttgttgataatttacagttaattggatataccttaattaagggacaaagtgtcaaagatttaaataaataaaagtgatgatgttttaataaaaaacatctttttttattaaaaatgtggtatcggtttcagttttttgttaaaaagtattgacagggtcacaacaatcgcttatagtatatttgtggaaccgataccatagaggaggataaaacatggattataacaaaattgccaaagaaataattaattgtgttggtggtaaagaaaacattacgggggcaatgcattgtgcaactaggctacgtttaaatctagttgatgaaagcaaggttgatgaagaatcattaactgatattgatgttgtgaagggaacttttttagctaaagggcaatatcaaattattttaggaccaggtctagttaatttggtatgtgacgaagtaacaaatattttaggaattaaaactgatagtacgctccaagtagaaaaagtagaagaaaaaggaaacttattacaacgtgcagttcagttattaagtgatatttttgttccaattattcctgccatcgttgctggcggattgttaatgggaattaataatattttaacagctcaaggactattttttgctaataaaagtttgattgaagcatatccgcaatgggctgatttagcatcaatgattaatttattttcaaacgctgcatttacttttttaccagtgttaattggatttagtgctactaaaaagtttggtgggaatccatatttaggtgcagctttaggaatgatcatggttcatccggatctactaaatgcttattcgtatggtaaagcaggagtagaagtaccagtatggaatatttttggactatcaattgaagcagtagggtatcaaggaacggttttacctgtattaggggtatcttggatcttagctaacattgaaaaacgtttacacaaagtgacaccaacttggctggacaatcttacaacaccattattagcaacgttaattactggttttattacttttattttagttggcccattattaagagaagccggggtcttattatctgatggaatatcatggatgtataatacgctaggattattcggaggtgcaatctttggatttttctatgcaccaatttgtttaacaggaatgcatcatagttttattgcagttgaaacacaattattggcatcgatcaagacaacaggtggatcattcatttttccaactgcatcaatgtcaaatgttgctcaaggggcagcagttattgcaattttattagtaactaaagacaaaaaattaaaaagtatttgttcagcttcaggtatttcagcgttattaggaattactgagcctgcaatgtttggagtaactttaaaacttaaatatccatttattgcagctatggtaggttcagcagttggaagtgcttatttagcggcaacaaaaacacttgctaatgctttaggggcagcaggtataccaggtttcttatcaatcgatcctaagaattatttgaattttgcaattgggatggtcttaagtattgcagtgtcatttgttttaacaattatattatataaacgtgatatggctaaacaacctactcaagatagtgaactgccaactgaagctaaagaagtaaaaacaaacattatcactgcaccgctagctgggaaagtagcttcaataacggaagcaccagatgagatttttgcacaaaaaatgatgggtgatggggtagttatctttcctacagaaaatattttagcagctccgattgatggtgaaattacaatgatctttcctacaaagcatgctttaggaattaaaagtaatgatggaattgaaattcttattcatgtaggtttggatactgtaaaacttgaaggaaaaccatttaatttatttgttactgaaggtcaaaaagtaaaacaaggtgataaattaatggaaattgattttgcgatggttgaagcagcaggatgtccaattgcgacaccattagttattacaagtcaaaatcaatttgaaattattaatcttggaacatgtagtttaaatcaagatataatcaaattagactaggagaaatagttatgacctgtttaaataatgaacaaatcaaaaaattagaaaaacaagcaagtaatgatgaatatcgccttaattatcatttaatgccacctactggatggttaaatgatcctaatggattatgtcagtttgaagggatttatcatctttactatcaatatgcaccagacgattgctttggaggtgataaatattggggacattatagtacaaaggattttattacttttaaaaatgaacctgttgccctgtttcctgattgttctttagatgctggaggtgcttattctggctcaacaataatcaaggataataaaatgtatgtttactataccggtaacgtaaaatatcctggggaacatgattatattcatactggtcgtgaccataatacaattatggttataagtgatgatggaattaattttggtgaaaaagtatgtctaatgaaaaatgacgattatccagatgacttgactttgcatgttcgagatccgcaaattattaaaagtggtgatcattattatatgattttaggagctagaacaaatcaagatgttggctgttgtttattatatcgaagtgatgatctggttaattacaaactagttaatcgcattatttctaatgaaccatttggctatatgtgggaatgccctaatctagttaaatttgatgagcagatgattttattttgctgtccgcaaggagtagaaacagcaggttatgattatgagaatttatatcagaacggttattatttaatcaacggtgatcttgaaaaagattatagattaagtgaatttattgaatttgatcatggctttgattattatgctccacaattatttattgatgagcaaggaagaactattattattggctggatggggatgcccgatgtcccttatacgaatccaacaaccaaatataattggcaacacgcttttacgcttccacgtgagctaacctttaaaaataataaagtatatcaattaccaataagtgaaactaaatcgttgagaaaagctaaagaaataattaatttgtctaatcatgaaaaaatatcttgtaaaggcaatatatatgagttatatttaccgataaataatcgtgattttactctaacattacgaaatgatgcagttattgattatcacaataatttgttgacattttcaatgggtgcaagtggttatggtcgtgattcacgacatatcgttattgatgatctatcaaatatgacgatttatagtgatacttcatcattagaaatatttttcaatgatggagaatatgcacttacaacacgtatatatgatcatagtagcaaccttgaaatatctattgacacagaaattcaatgtacttactatgagctaaatagttatcagatagtttaggtatctgaagaggtcgtgaccaggttacgacttttttattttcttagtatgacatttgtcactttaaaattgtgatgaaagcagttactatataattacaaatgtaatgtataaagaaatagggggaatttatggaaatcaaaaataatcaaaaaacaattgttaaaatgatggtatttctttgcctctgtattacgttgatgatttttggattttatagttatccagattttaaagcaacagtaggacaacagcgttttggggcaacctatatgacgatgaataatccattttttgaagtgattaataatgagataaaaaaagcggttgaagcgaatggagatgtcttgattacacttgatccaattttagatgttgataagcagaatgaacaaatattagatttgattgaccagcgtgttgatgcgatttttgttaatccgattgatgctaaaaaaatagaaattggattaaaagcagcaaaaaaagctaagattccggttattgtagttgatgcccctatttatgatgagtcattagtaaattgttcaattgcttctaacaattatgatgcaggtgttttatgtgcaaaagatatgatgagtaaacgagatcatgctaagattattttattagagcatgctactgcaaagtctgcggtagaacgtattcagggatttcttgatactattgctagtaatgctaattatcaagttataaatcgtgctgactgtgatggtcaaattgagattgcaatgccaacgatgaaacagatgctaaaagaaactcctgctgtagatgttgttatggcattaaatgatcgtagtgctttaggagcattggcagcgattgaatcaatggaaatagataatgttttagtttatggagtcgatggttcgcctgatgttaaagaattgatcaatactggactgattcaggcaacagcagctcaatcacctgtcaaaatgggacagttagcttatcaaaaagcgaaagcgttattagaaaataagaagattgaaaagaaaatagaagtaccagtagagttgattagccgtgataatatttctaactttgagttaacggggtggcaatgatgcaatacagtgagtatcgctctgtatcgtcaattaaaaatatgatgatcataatcaattttattattattttatttgaagctagtattattttattttcaacaaaatatgtttgtaataatttgatggggcgcgattttttagatacattagcatatttaccaaagaatccgactaaagtatttatttattcaattataggatttgcattgttggtaatgattatgttcattagaaaatctgagaattttcaagttcgaaatggacgagtcatttgtaatggattagaaataattttatgtttctggattatttataatctttatatgggctataatggaatagctttattagtgtttgcagatataatttttaataccaaaaatgggcgcaatacaatggttattatcgggtttattttaattatttttttgttatctaactatgacattatttctaatataattccaatggtttctttagacagctatatacaggtttatgatgccgcgacgaaaactgcgattttaatagctaaaaatattcttgaatcaacaaacctagtcttgtttattatgtttttaattgtctatattgcaaatcaaattagagaaaatgagaatatttcaaaagaactttctatgatcaacgaagttaataaacaattgaaggattatgctgcggtgacagaaaaaattggcgagagtaatgaaagaaaacgactggcacgagaaattcatgatacactcggtcatgctttgacaggaattgcagctggaattgatgcatgtattgcaatgattgatatcgatcctaatgtaactaaacaacagcttttagttgtttctaaggttgtccgtgaggggattagtgatgtccggcggtcacttaataaattgcggcctggagctttagaagagcacacattaaaagaagcaattcaaaaaatgattaaagaatttagcgatgtttcagaggttgagattatgcttgattatcagttagataaagttgattttgaaaatactaaagaagatattatttttagaattgttcaagaaagtattacaaatgcattaagacatggacgagctaaaaaggttgaaatcaatatttaccaaagggtatctgatttagaaattgttattgcagataatggagttggctgcgatgatctaaaattaggttatgggttaaaacaaatgcaagaacgggctgctattttaaatggacgtttagaatactatagtaaagaaggttttacagttaaggttacaattccaatgaaagagggggaacgatatgattaaggtattaatcgctgatgatcaagaattaattagggaatcattgaaaattgttttaaatacacacgaagatttacaagtgatcgatacagtagaagatggttttggtgtattagacagtctaaaacgaaatattccagatgttattctaatggatattagaatgccaagaatggatggggtatattgcacaaagatggttaaagaagcctatccggatgttaaaataattattttgacaacatttgatgatgatgattttgtttttagtgcattaaaatttggagctagtggataccttttaaaaggagtatcaatggatggattgtatcaggctattttaactgttgtttctggaggtgcaatgatcaatccggatattgcgacaaaagtatttagacttttttcgaagatggcaaatactaattatgcaatcaatgttaatgatgataatgttagggaattaaataaaccagaatggaaagtaattcaacaagttggttttggtttatcaaataaggaaattgctcaaaaattatttttatctgaaggaaccgttcgaaattatttaagctctattttatcaaagctagaacttcgtgatcgtactcagttagctatctgggcagtccaaacaggtcaaacaacaaaggatcttgacgatgattaaaaagaataaaataatgattattgtcttagttttagttatgggaatcgggttaatatattaccacaatcaaaagaaagttctaacaatcggaatatttgcgggaagtaattgggatgttcctacgttcgattattatgaaatgattgataaaataattgtccgttttgaaaaagagcatcccaatgttgaagttcaatataaaagtggaattcttaaggaagattattctttatggttatcaaatcagttattaattggtgctgagcctgatttatacatgattttaaatgaagattttaattccctatcagcattaggcgcattaaaaaatttagactcgatcattactgatgatcaagattttaatagtgatgaattttatcaaagtacttatcaggcaggacagtatcaaggtaaacaatatgctttgccttatgaagtaaatcctactttaatgtttgtaaataaaactttgctacaacaagaaggaatcagtcttccaaaggacaattggtcgctagaagaattttataatgtctgtcgacaattgactaaagatagtaataatgacggaattatcgatcaatacggctgttataattatgaatggatcaacgctatttatgctagtggaatagagttatttaatgaaactggaacgacctgtgattttaataatcacgaagtaaaaagtgctattcaatttattgaaaaactgaatgctttaaatcgcggctttaatattacttccaatgatttcgatcaaggcaaagtagcttttgcaccaatgcagttttctcaatatcgaacatataagccttatccttatcgagtaagtaaatattctacatttgaatgggatgtgattgaaatgcctcaaagttctgagcaacatttaacacaattatcatctttaatgatggggatgtcgatgcgaactagtgctcctgagttagcttggcaactattaaaagaatttacttatagtcaagcttcacagcaggatatttatgaatatagtcaaggggtatctccattaaaagaggtgaccgaatctaaacaggttttgaaattgttagaggaagatacgcttggtgatagtaaaattgatatgcgggtattaagccaggtaatggagtatccaaccacaaatacgcgatttagaaaatatgaggcagcaatgaagattgctgataatcagattaatcaagcacttcaaaacaatctggatttagatacttcattaactgctttacaaaaagaaataactaattatttaaacgagtagcaagtatgactattcgttttttattatgacaaatgtcattaaaaaaatgacatttgtttatgaaaagaaatgacaatgctcagatgtattgaaaggggttacttgataagatatagatgtcaaaagaaagggaggttaaaaatgaaatatgtaatattagttagtcatgggaacttcgctgaagggttactagattctttaaaaatgcttacaggtaatcatgatgatgtaattgcaataggattaaaagatggaattacagctgatcagtttgctatagactttactgagataatcactaaaattcctaaagaaagtgaaattatcgttttagctgatatcataggtggttcacctttatcaactgcaatgaatgtattggcacaatcaggattgattgataaaacgacagtacttgggggaatgaatttaccattagctttaacaacaatattaatgaaagatgttttagatactgatgctttaattacaaatgtgacgagtgaggcaacaggtgcaattaaacaatttgttttagaaacaaatgatgaagatgatgatatttaggaggagaagattatgtcagtttcatttgtaagaattgatgatcggatgattcatggtcaaacttgtacgcgttgggctagagaatatccttgtgatggattaattgctgtaaatgataaagcagcaactaatgatgttttaaaagctgcctataaagcagcaagtggtaagaaaacatttgtttggacattagcagatttcgcaaaaaaatcacaaaaagttttagatagtgacacaaaatatttcttgattgctaaaaatccaattgatatgtgtacgattttagtagatcagggatttgatcctggtgttaaaactgttattgtaggaccttgtaatgatcgtgaaggggctactaaattaggtaataaccagtcaattactcaagcggaggctgatgcgtttgaacgtatccataaagctggttatacaataaaatttgctttattaccagacgtttcgattgggacatgggatgatttcaaaagtaaatttggttattaaaatataaatgtaaaggggatttttattatggaaataagttggattcaagccgccttacttggattatttgcttgcttatcaagtatgccaggtttagggggaacatcatttggtaactacacattaggtcgacctttagttggtggtttagtttgtggaattattttaggtgatattcaaactggaattttagtagggattgcaatgcaagtagtttatatcgctcttgttactccagggggaacagtttcggctgatgtacgggcagtaagttatatagggattccacttgctatgattgcaattaaaagctatggtctagatgctgcctcaagtgacggagctgcacttgcaacatcatttggaacaatggttggaactttaggaacagttttattctatggtactgcaacgattaatctagcatggcagcatattggctggcgggcagtagaaaatggagattataaaaaattatatatagtagatatggtattaccttggatttctcatattttatgttcatttattcctgcgatgatcatgtgtaaaatgggagctccgatggttgacttgataaaaacctatttaccaatggatggggttgcaatgaaaacattatttacagtcggttcattattaccatgtgtcggaattgcaatcttattaaaacaaatcgttactaaagcaattgattttattccatttttctttggttttactttagcagctgctttaggaattaacttagtttctgcaactgttgttgcgggaatgttcgcattgatcaattatcgaattaaaatgttgacacttggtaaagtcgcagttgctgtagttgatgatgacgaggaggatatataagatggaaaagaaattatcaaaaaagaccctaaccaaatcttttcataattggtattatgggaatttaacatgtttttctcaagaacatatgcaaacatttggctatttgtgttcaatgttaccaattgttgaagaattgtatgataaaaaagatgctcgggcaaaagccattaaaacgtatactgccttttttaacaccgaaccgcaagtaggttccgtgatcgttggaatgacagcggggttagaggaggctcgtgctaatggtgctgaagatgtagatgatgaaacaataaatggattacgtgcaggattgatgggaccgttagcaggaataggagattctttagtagttggaacgataattcctattttattaggggttgcaatgggaatgtctacaggtggttcaccattaggggctattttctatattattgtttggaatttatttgcttattttggaatgaagttattatattttaaaggttatgaattgggtggtaaagctgtagattttctagttggacctcaaggagaagctttacgagaatcaattacaatgttaggtggtattgtgattggggcagtagcagctacatgggttagtgtaaaaacaagtttttcgatgactgctgctggagctaaagagccgtttttagatttacaaaagacgttagatggtgtttatcctggatttttaactgctttattcgtgttattatgttggtatttattgtctaaaaagaaaatgtcaccaatcaaagtaatgttattattagtggttattgctcttattggagtattggttggattctttaacccgggattaacatattaaaaaggagaacttaaaatggatcaaagagtaaaaaaagcatattttgaagaaatagaatatcagactaaacaaattaatcgattaaaaatatggctaaaaaatttattaattatttcctctcttattatagctatcatattttttgtagataaaataagtatgattattactgtgatttcatacattgctttaataataatcataatttctttgattattattaacttggcgattcgtaatggttcaatgaatgtaaacaatattattattaaaatggaacatattaaataataaattaaacaagcccctaaaggagtatttatggtttagtaaaaaaggggctctgatgattttaatagagcttatattagctggaaactaggaaattttaaaatttcctagtttttttcgaaacatttgtttttagtttgacacactattaaatcttgagtaacataagtacattggaggtgtactatgctgttaataaataaaacattaattagaatgtccgaaggaattagaggttggattgcaataattaccggacttaaaatattaacattagtaggaacagtaatgtttgctaaaactatttcatcctttttaagtgatctatatcagccgaaaatgtcacaagagcagttgctggtagcaataatcagtgcattgattgcttcatgtttgattttaatagctgatctattaactggagaagccgaatatcgctgtggggccaaagcacggattaatttgcgtaaagagatttttgaaaaaatgcttcaattagatgttggtaaaattgaaaggattggagcaagtaatacaattagtagtgttggcgatggagtggagctaatgcaggtttattacactaagtatttaccaagtttgctgtattgtttctttgcgccagtttatttattttttcagttaaaagatacttcgctgctagtagcgacaatactactgattatttcattaagtttaccgttagtaaataattattttagaaaaatgattgatcaattaaagaaagaatattggactagttttcaagatttaacaagttattatttagaaagcttaaaaagtttggttactttgaaattatttaatcaagatcgacgtagacatgataatttgaggcgaaaagcggatacatttaatcaaagtacaatgtcgattatgaaaatgaacttttcatcatttttggtttcagatggattaatttatttaggtgttattctggcagtagtaattggctgttcacaattggctaaaggaacgattgatttagcacaggcagttttattgttaatgttgtcatatagtttttttagttcaattagacaattgatgtctgcgactcatgatgctttatcagggattgcggcaacaataaaagtagatgaaatattaaatttagatgcttcaagaattcataagagtgaggctgaaacagctcacgaaatagcggttaaatacagtcaggatactttagcttatttgcaggattattcggggatcatagtaaaagatattgtttttaattatcatcaaaggcgccaagttttaaagcagttaagtattgaaataccaaaaggtaaaacaactgcaattgtaggtaagagtggttgtggaaaaagtacgttggcaagtatgctaatgcgttttattgacccagatcaaggctatttatttcttgatggtcaaagttattttagtttaacgcctgaagaagttagaaaaaacattgttatggtaccacaacgggttagtatttttagtggttcattagaagaaaatttgaaactggctgcaccaaatgcttcaacaagtgaattattaaacgttttaaaacaagtgcatttatatcaatggttgcaaagtttgccagaaggcttatcgacagatttgggtgatagtggtgctaaattatctggcgggcagcgtcaaaagattggaatcgccagagctctattaagtggtgctccatatttaatttttgatgaagcaacttcaagtgttgatcgtgatagtgaagatgagatttggcaatgtattaatgagcttggtttaactagaacattaattattatttctcaccgcttatcgacaattcaacgtgctgataatatcattgtgttaaatcaaggaagattagttgaacaagggaatcatcaagcattattaaaatatcatggtgaatattatcagttggtaaaagaacaagaagctttagaagcagcgggaaaggtaggatagattatggaacataaacaatcattattaaccttaaccaaacgattattgaaaattgctgccacattaaaaaaattctttgttatttctacaattgtcagtataattggaaatattgctcaaatggggctaatgggatttggagctgcttttattttgagtgttgccggaaagttaaaatatgccaatagcgtcacatattgtattttaatgattataagtggaattttaattgttacttgtcgttatcttgaaggatatttttcacatgctggttcgtatgaattattagctaaaatgcgagttgacatgtttggaactttacgcaagttggcaccagggagtttgatcggacggaataatggcgatatcatggcaattgcaattgctgatatcgaaagtattgaatttttctttgcacatacgattgggccattatttaccgttattttacttccgttagtgactttgattattgcaggaagtattgatatgctttttgtctatgcactgttaccaatctatttaattattagtgttattattcctattttagccattaaactgggtcgtaatataggaattggttatcgtcaaaagttaggagaattaaaaatatttttattagatagtgtatatggattatcagaaattcaaatttttgattatggaaaacgtcgtaatgaagaattagaagctgttaatcgcaatataaatcgttcaattcatcaacttgcttatcaccgccaattagttgtttccacgccaacgtttttcatttatcttgctcgaattgctgtaattgcagtagcttcatatcttgctttaaaaggaaatattgatacaaccggaattattatcttatcatttttagtttcggcttcattttcatcgacgcaatcattaacgactgtagtttcaagtttacttgaaacttatgcggcggcacaacgctattttgatttggaagatatggttcccgtcgtaaatgaaattgttgagcctaaagaattgaaaaatatcgacaaaattgaatttattaatgtaagttttagctatcctgaaattaatagaaaaattattgaaaatatgaatcttaccattaattttaaagataaaattggtcttgttggagaaagtggaattggcaaatcaactttgattagattgttattacgtttttatgatgttacaagtggtcaaattttaattaatggtatagatatcaaagaatactctttgcaagatttacgtcaacgaattggaacacttgaacaagacacttttctttttaatgattctattgctgctaatattgctttaggaaaaccaaaggcgacaaaagaagaaatcgtaaaggctgctcaaatggcaggaattcatgaattgatcattagtttaccagaacaatacgatactatgatgggagaacttcagaatcgattgtcaggtggtgagaagcaaagaattggaattgcacgggttttattagttgatcctgattttttagtcatggatgaaccaacaagtagtttagatgttattaatgaaaaaggtttattgaagacattggctgaacaatttgaaaataagacatggttaattgtgtcacatcgaccttcttcattgacgggatgtgatcgggtgattaaattagaaaataaacaaatttatgaattaggaggaaaagcttaaggcttttctttttttatatgctaaaatatgttcaggaggaaataagtgtgaaagaaaatatgaaatatttaactaaccattatcagttaagagaatttactttaataagaatgttagaaattattaatcaaaataaaaatataactcctggaggaactgttttttatggggattcaattactgagtattgtgatctggacaagtattatcctgagatagagactaaatataattgtggaatagcggggattacttcaggaatgcttttaaatttcatcgacgaaggggttatcaaatatcaacctaaaaacgtggttttgatgattggaacaaatgatcttggtaatacggtcatggagagcccccgtgatattgctttaaatgttaaagaaacaatcgaaattattcattataattgtttggatactaaaatttatcttgtagcaccattaccatgtttagaaatgcttcatggttataaagcaacaaagcaaggattacgcagtaatgataccttaaagatggtctttaaagagtataaaaatattattccgtatgattatgttactttgattaatccttttatggcactttgcaataaaaagggccaaccagttgaaaattattatcttgatggtcttcacattaatgatgatggatatcgggcctatacaggggtaatcaaagaaaaactgatagattgaattagaaaatggggatagctaatagattgtttaattacaacaatgatgctagaatactactaatggttgatttggggaggaagatattatggatacaattatcatcgttataaaagatagtgatgattgtttaagattaaaggagtttttaagtagtgactatcatattgttatatgtagtgaacttgaaaatattattgataaccttaatgataatcgaatcgttgctattattatggacttagatgatgcgactgaagttaatgtcgcaaagtattctagttataaaaatattgataatattcaaatccctttaatcgtaggtgggaactttacgggaaatcttcttaatttattaaatttaggagttagtgaggtaattgttaagccttataatgaagcaattattaaattacgaatcaataatgcaattcgtcgggccgaagataatgaatatagaataatggctgattttgatactttaaccaagatctataaccgtactgctttttatcgcgaagctaaaaaattaattacgcaaaaccaagatattaattatgatcttgcttgttttgatattgatcgatttaagattattaatgatatttatggtagtagtgtcggtgatgaactattgatttatattgctaacacgggagttaagcggatgaagaaacttggcggattaattggacgtttaagtggggatttatttgcaatcgtagttcctcatcaagcgaatattgaagacctgttgcttcaacaaatgaatgaagacattggtaactttgatcttggaatcaaggttgtagtcagttttggttattataatattgatgatctatcattaccagtcaataatatgtgtgatcgggcaatgatggcgataaaaaaagtaaaagataaatacaataccagctatgcaacttatgatgatgaacttcgagatcaagttttagaagaacagagaattattgatgaaatggatcgtgcatttgaaaatgatgaatttattccttattatcaacccaaatttaatatggtaacgaggacatatattggttatgaggcattgatgcgttggcagagtccgactcgaggaatggtgttaccaggtacctttattccagtttttgaaaagaatggttttatttctaaagcagatcgggtaatttggcgtaaagtatgtcaagatatggttattgcccgccaaaaaggacatgtcttattacctgtatctgtaaatgtttctcgaattgaattatatgatccggaattaggaaatactatcttaaaacttttagcggaatatgagctgtcgattgagttatttcaattagaaattactgaaacggcatatatgcaggatagtaatcaaatgattgaggctgtagtaaagttaaaggaacttggcttcactattttaatggatgattttggtagtggtttttcatcgttgaatatcttaaaggaattgccgtttgatataattaaaattgatttggcgtttttggaacattttgataaaaataataaagctgaaaagattttaaaatcagtgattcaaatggcgaaacgccttaatatggaagtaattgctgaaggagtagaaaccaaacgccaagaagattttttagtagaactaggttgtaatcgtgctcaagggtatcgttttgctaaaccagctagtgcttcaaaaattgcttatatggttgaaaatggtgtcatcggagtaggtgatactaaagatgaggatagtgcaatagttaatattgatgatattttaacgactgtttatcagcaaggggaagtagattggtatcgacaggcactattagaattaaatgctcaagttttcgaatatgattttaagcgtgataatatgattatttttgatactccaacaaaggaaaatggttctaatttagctaagatggaaattcccaattatctttacaatgtaagtattggtagaatcgtacattcaaaagatgtaaaaagatatcagactgttttcaatggtaatcaggaatttaaggttatctatcgacgttttatgattaaccatggttctggttatacttgggttaaagatacaggaagaataatttatgatgaagataacaaaccaaaaatatgtattggtgtaagtcgtgttatttcagatgaaaagcttaatgaacaaatgatgaatgttttatcagtaatggagcagtcaactgattttgattcatcaatcaaccatattttggcagagatcggggatgattttttacttgatcggattacgttattactagaagaaggaaacaattatcgttctgtctatgcatggcaagatgagtcgattgagcttgagattagtgatactttcccaatagtgaggacagagcttcaagaaatagtcacatattttaaggagcatcaaataattgttgttaataaaaatgaaggtaatcaatttagtaaacaaattaataaaaatttctttgataatcaagtaaagacacttgttatcattagtctaaacgatgatattggtgaatttatcgggtgtattgtttttacaatgataaatgattatcgacaatggcgcgatgatgaactttgggcattacaagaattagtaaaggggataaatgtctatttaaataaagagaaaatttttaatcgtttagatagcatattattaacatataatcgtgttatggaaaaattgaatgatggaatattgatgtttacatatgagtctcagccccagctgctatttattaatgaagcataccgtaagatattaaatattgatgatataaatgttactaattttcttagtacgtactatcggagcgtcgatttggatgttcaaaagcaaattcatcaggcaattgaaaagtgtgttgaaactggggaagaacagacgctttatcatccacttaaaacttgtgaaaagcagattattaaggctaaaactatttataatctttcgccagttaaagaaaatggtaaattggtaattattagcattactacgaaacagtgcacttaagtgctattattttatacttgtgtataattgtatctaggaggtcataataatggcagaaatattgattattgaagacgaagttaaattgcgccaagaactggaagtatatttaaataataatggatatttgactaaagtaattgagtcttttgaaaatactttagaacaaatgaatcagtttgatggggatttaattttattggatattaatcttcccaatgtaaatggacagtttttatgcaaagaatatcgtaagaattcaagtaaaccaattattattgtaactagtcgcaacaatgagatggatgaattgatgtgtattaattatggtgctgatgattttgtcacgaaaccgtataatccattaattttattggcccgaatcgaagcggtcttaaaacgaacacagcctacaagtgatgttttgattagttatgaaaagataaaattagatgtatctaaaagtagtattattgataaaaataaagtgattgaattatcaaaaaatgagttaaaaatattttactttttattactgcaccgtgggaaaattaaatctcgagaagaattaatggcatatttatgggatagtgatatgtttgtggatgataatacattgactgttaatattaatcgcttacgtaaaaagttagaggatattggtttaaatgatgtaattcatactagacgtggtcaggggtatatcattttatgagattatttgattatttaaaagatgaaatcattacggttacagtaatgatttctgtgacttgtttggtaatgttgattttggcagtttttaattgtccaacttttttagtagtctacattccacttctgctcattagctcatttgtagtagtattaatgtataatttttttcggcgtagaaatttttataataatttgataggaatcttagatcatcttgatgaaaagtatcttattactgaattgattggaaatcctcattttctagatggtaaaattatggttaactgtatttatgaaattgataaatcaatgaaagaacatttaaatgatgcaatttatcgacaaagtgaactcaaagagtatattgagatgtggtgtcatgaagtaaaaacacctgtagctacaagtcaaatgattattgaaaataatctaaatccagttaatgagagtattaaagaagaactcataaagatagataattatgttgaacaagtactcttttatgctcgaagtgagaatgttgaaaaagactatttaattaaagatgttaaacttagtgaattagttaattcagtaattaaacgtaataaaaaagatttaatcaataaacatgttaaaattgaattagagaatcttgaaatagatgttgctagtgataaaaaatggttagagttcattttaaatcagattattaataatgcaattaaatatgttgatgaaacaccaataattaaactatttgcaaaacaatataaagatcgtgttgaattaatgataaaagataatggaattggaatcttagaaaatgaattgaatcgtgtttttgataaaggatttacgggaacaacgggacgaactaaacaaaagagtacgggaattggtttatatttatgtaaaaaattatgttatcgattaaatcatgaaattaaaatagattcaaattcacatggtacggtagtaactttggtttttccgtacagctcacacataaccttacaataatgtaaggttatgttattttattcgatggtagaaattattatgacggctataatagttgttgaggtgaagagaaatggaaaaaattttaagaattgaaaaaattgaaaaatattatggaaataaaaacaacattacaaaggctgtcgataatattagtttcgatgttaacggtggtgagtttgtagccattatgggggctagtggtagtgggaaaagtactttactaaattgtatttcaacgattgataaagttactagtggtcatatttatttaaaggatgctgacattactaaactaaagggatataaattaacaaagtttagaagggattcgttaggctttatctttcaagattttaatcttttagatacattgacttcatttgaaaatattgctttggctttaacgattcaaaaatcagattataaaaaagtagatgagaaagtaaacaaggttgcagcagctttaggaatcaaagaaattttatcaaagtatccatatgaattatctggtggtcaaaaacaaagagttgcttgtgctagagctatcgttactaatcctgatttgattttagcggatgaaccaactggagctcttgatagtaaatcagcaagaatgttattagatagtttgaatgcgttaaatgaaaaattgaatgcaacaattttgatggttactcatgattcatttacagctagttatgctgatcgagtaatctttatcaaagatggtaaaatctttaacgaaattgttaaaggtgataattctcgtaaaatgttctttaatagtattatggatgttcaaacattattaggtggtgaactaaatgaagttatttagtttagcacttagaaatattaaaaagagtataaaagattactcaatttattttattacactagttattgctgttgctatattttatatctttaattcgattgatagtcaaacagcaatgatgtcaattagcaaatcaacaatggaaattgtgcagtctttagtaaatgttttatcatatatttcggtttttgtttcggtagttttaggatttttaattgtttatgcaaataatttcttaattaaacgccgaaaaaaagaaatcggtatttatatgactttaggaatgtcaaagttaaaagtatctacgattttagtacttgaaacagttattgttggagtgatttcattaggaatcggtttactcttaggaattggcttatctcaattgttatcaatttttactgcaaaattgtttgaagctgatatgaccaaatttacatttgttttttctagtggagcacttttatcagcgattattaattttggatttatttatattattgtaatgattttcaatattatcacactaaatcgatttaagttgattgatttattatatgcaaatcgcaaaaatgaaaaggttaaaataaaaaatggctggttaatttttattatttttattatctctattgttttgattgggtacgcatataagttattgtatgatggcgctttatatgttgtgggttctgattttttgatcatgattattctggggacgattggaactttcttgtttttcttatcagtatcaggttttttattaaaagttgttcaaatgcgcaaaaagacttattataatggtctgaatatgtttgtattaaaacaagtaaataataagatcaatacacatgttatttctacaacagttatttccttaatgttattgttaacgatcgggatattatcatcgtctttagcgatggcctcagcaatgaacactacttatgagggaaatagcccaagtgatgttactgtattttctagtaatactgaaattattgaaagatttaaacaggaaccggtgtatcaacaaatcatcaaagaggattatcagttcaattatcttaatttacaaggattaaaacaaggtatttttattgattcaaaagataatgcttatactaatatagaagcagtaaaaaatcaaccgatgcgggtaatcaaagaaagtgattttaataaaatcatggaattaaatggtaaagaagatcaaaaaatacaattggctaataatcaatatgaattagtagcaacttatcctgtagcacttgaatattataataagtttctagctggcgatagtacaatcaaaataggagatactacgcttcaaagtaatacggatcaagcagtagaattggcaattactaacgatagcggcaatgaagggtttgttgttgtaaatgaccagattgcaaataaatatgtggaagaacaagaaagttatttaacttatctagtggcagactatcaaggtgataaggaagaatgtgaggaacaattccaagatttgcttaaatcttttaatgaacagttaaggactgaaagcagtccaacagttattagttttacccggattggattagggcaatcgggaattggaacgagtgctttgtttacttttgttggactgtatttaggaattgtatttgcacttgcaagtggtactgtgttagcaattgaacaattatcagaatcttctgataataaagaacgttatcgtatcttaggacagttaggtgcaagtaaaccaatggtaaatagaagccttttagttcaaattggaatcacatttatgtttccattaatcgtagctttaattcatagttttgttgcactaaaagaaataaattatattattagtttgatggtcagcattaatatcgctgataacatcttggttacgacgatctttattgtaattgtatatggaggttattatttagcgacttatttagctagtaatcgaatcattaatgaataaaaaacccgttatgggttttttagtttaagagcgtatgcggaagttcgtagattatatcgtcatggctgtatgtacgaatttgtttatgaggtaaaatagactggcgatcttctaacaatccatcaaatacaatcttgtgtcgataggggagcagtgctaaattacagacctggggcaaagttgaattaggataaatttctttaagatgattaacaagcccataaatagcataaacaccagtttcattactaacgagcgtatagtcatcaagatttgttaaaattaaaaagtcatcaataaagccagctttaaaatcattaataatagtcagttcataattggttaggtgctcaggattttcactgatatagtggtcgattatatttggattatcaaatagtaaggttcgaatttgagaaaaatcatcttgctcaatataatcaagatttttcattgaaatatctgtaattttaaaaacttggttagtatactctaataaacttaaatacagctgataaaaggtagaactctcttgctcactgaaataagaatctttgttgattgtcaaatagtaatcatatggggataatccataaaaagcagcactatgaattaaaggaactgcagcacgtaaattcttttcaagatgttcaataacttgattatttgtaatttttaattcattaatcatataaatcaaatcgttaaggtcaccatgaatttgacaaaaaagcataatactatctctaaataattctcttacaaaaagattatcaatttgttcgactgcttcatagaggttagtgatggctggttcacttaagtcaaagccatatttagcgatcgttcttaattgtttggcggtataagccgcaggagttttttttactaatgtttggagctgttcaattttttggataatcggccgatatggctcataagctaataataattcagtttccccttgataaataaagtaatgctgaaatagatagtgatttgtatctaaatgagtgtttacttcattacgtgaaagtgaaggatcataactatgataaatatttactaattcttgtggttcaataatacctctaatggctagaataccaatcaataattcattgatttgatctatttgaatgaccttgtcaatatccgcttgttctacagcattaataacatttatctttatgtcttcagggatttctaaatagttattattattaggatttttaattagtaagcatttgttgatcaatgtattgattgtagggatatctttacgataacttttggttttttcaaaattttgtaagaaaacgatttcgtcataacataaaatatctaaaacattttgaatactgccattgtagtatgctacgatctcttgataaatctgttttgaggtaatttgatgcggtggtttaggggtggcaacaatcttaaaataacgctggtaaatatgctgacattcaggtgttgtaattaattcaactagtttcattaaaccacctccttatacttataggatactacaatttgctgggagtttaaaatgatatacaaagaatctttacaataaagataagctatgcttataatgatcaggtgaggtgtaagatgaaaagaagagagccggtaattcatgatttaaataagtgttcatttcatgaaatagaagataattattatcagtgtttatttaatgaaaatcctcaacaagttattccaattaaaaatttaacgattgaggaatgtaaatttattaagattgattttaatatgatcgaattagttaatactcatataacagattgtatttttgaaaactgtgatttatcaaatttagaatttaataaggttagtatccatcgttgtcactttattaactgtaagatgacagggctaaattttattgactgttctttacaagatcttttatttgagggagtacaaggacgctatatgaatattagtcttggaaatattcgttgtgttgagtttaatgatagtacattagatgaaagtagttttatggaagtgaatgttaaaaatcttgtttttaaacaagttagttttattgctggagaggtatttaaaacaagcttaaaagggatggactttaagaccactaatattgagggaattagaatcgatgattatagtttaaaaggaatccatgttgatatgtatcaggcaatcgctttagctagtttattgggaatcatcgttgattgaattcaatgacaaaaaatgaaattaagggctatttaagcccatttttatatcaattaaaaaaaataatgacaaaatacaattctgtgatataatgatgaagttataagagaggttgagtaaatgaagataagaaatattgcgattattgcccatgtcgatcacggtaaaacaacacttgtagatcaattattaaaattatcgggtacatttagagataatgaacaaatagcagaacgtgcaatggatagtaatgccattgaacgtgagcgtggaattactatattggctaaaaatacagccatcaattataaggattatcgcatcaatattatggatactcctggtcatgccgatttcggtggtgaagttgaaagaatcatgaatatggttgatggggtattattagtggtcgatgcttatgagggaacaatgcctcaaacacgttttgttttaaagaaagcattagcagctaaagtaaaaccaatcgtagtaattaataaagtagatcgtccagtagtaagaattcaggaagtaatggatgaagtattagaattatttatggaattaggagctgatgatgatcagttagaattcccgactgtctatgcttcagcattacaaggaacttctagtttggaccctgatttatcaactcaagaaccaagtatggactgtttgtttgatatgatcattgatgagattccagaaccattagttgatgaagaaggaccattacaattccagccggctttattagattataatgattatgtgggaagaatcggtgttggacgaattcaacgtggtaaaatacgagttaatgaaagcgtaacttgtgttcgtgctgatggttcacacagtcaatttagaatccaaaaattatttggttttattggcttgcatcgaattgaaattgaagaagcaggggctggagatattgtggcgattgctggtttagctgatatcggtgttggtgagactgtatgtactacgggaaaagaagaagctttaccattattaaaagtagatgaaccaactattcaaatggtttttggtactaatacttcgccatttgcaggtcaagatggaaaatttgtaacagctcgtcaaattgaagaacgtttatttaaagaaactaaccgtgatgtatctttaaagattgaaagaattcctaacagtgaagaatggatcgtttctggacggggagagttgcatttgtcgatattaattgaaaatatgcgtcgcgaaggatatgaacttcaagtttctaaaccaaaagtaattattaaagagattgacggtgtactttgtgaaccatatgaagaagttaatattgaagcacccgatgactgtattggtaatgttatagaatcattaggatatcgtcgaggtgtacttgaaaatatggttagtaatgaaggacaaacaagtgtcacatatacaattccttcaagagggatgattggttttatgacaaactttttaacaatgacaaaaggttatggaattatttctcattcattcttagaatatcgcccaatggaaggtgaatcagttggagaaagatcacttggtgttttagtttcgatagataatggtcaaactacagcctatgctttaggtggggttgaagatcgtggagttatgtttattggtcctggtgttgatgtttatgaagggatgatcgttggtgaacatagtcgtgacaatgatttagtagttaatgttacaaaaggtaaacaactaacaaatacccgttcttcatcaaaagactcaacagttgttttaaaaaggcctcggacatttaacttagaagcttgcttagattatattaatgatgatgaattagttgaagtaacacctgaaaacattcgtttgagaaaacgttatttaacagaacaagcacgtaaacaacaaaaccgtttaaaacaaaataattcataaagcaggaaatttcgattttctgttttttcttttttattcaattttgttagacaaactttgtaggaattttctaaaaaaagataatatttttatcgttaattcttaaaaaatgatgattaacactataaaatttgcatatttggcttgaatatgatattattgattcaagaagaaacgggggaattatttaaagatgaaagcaatcgtagaagtacaatatcatgggaaaaacgtaacagcaactgatattgaaaaattggtaaaagaggacgttaaatcacagggagttaaaatttcaactgttgatacgttgcaaatatattatacaccagaaacttcatcagtttattacgttgcgactacaaaagatggtaaatctgtaaataacgaagaaccattagttattgagtagtcttaatataatatccaaaaatatatccaaagcaagaaacgataatttagattatcgttttttgttttattatcatcaaaggtttgtggtttatcgacaaaaaacatgctataattattttgttttgaaggagtgaaaaaaatgaaaaaaattacagctggtttattagcatttttaatgctaacaggatgttcaaatatagataacgatcaaacattgtttgtagctaataataaagaaaaatatgcgcttatggattatgaaggtgataagcagactgaatttatttatgataagtatgaagaagttggaagttctggttatattgtaattaaggataaaaagtatggatatcttcttcgtgatggtgaagaagcaatcaaattaggaaaatatgataaactagaatcaattggaaatatgattgttggttatgataagaatgaaaaaattagtattttagatggtgaaggaaaagaattatacaaggaagataaaaagacagagatttctttattcgggttaccggttattcatcaaggtaaagaatatattgttttatataatgatggtgaggtattaaaaaagagtaaggagaagattataagtgcatatacagttgatagtgattatgcggttattaattttgaaaagacctcatctatttacaatttagttaatgaaaagcatattgaaggaatcaagattggtggcaataatcagttgatggatcatagtagtaaaaaaggttatttgctttataatcgtaaaactcatgagattaatgcattggatttagaaggaaaaataatttttactacaacacttgaattagatgatttatattatgataattcaaaaaatattattggagtaaaaaatcaaactacatatttatttaacaaagatggtgaaacagtaacatcaaacagttactatcgtaactataaaaattatgttgtaaagaataaagaaatgatttacggaccacataaattcgttaatgatggtaaagaaatagaggtaaatgggattcagttagacccaatggcatcatttacaaagagtaagattttcccggtgtatgtgcgtgatgaaggttaccaatattatggttttgatggtaaggaagcaataaaggaatcttataagagtgctgaagcttttgatgaaaataatcttgctgtcgtttctaaaaaagaagataaatattatttaattaataataaaggcaaaaaagtatctgaacaatatgtacgaattatgtatttaggtgaaaaatattatgctggatatactactggcagtaagtatgaagtatttgatgtagaaggaaataaagtaattaatgactattttatggacgaagggacaacctttgtgtataatgatgtagtttatggtatcttcaacaagagtggaagcagttatatttatgatatgaatgaaaatgaagtggttttctcagttgaaggtgatttagaattcaatgaaaaagggtattttgtaacagttgatggtgatgcttattattcattgaaaggcgagaaaatttataagaggtaaagaaatggaatattatatttacatgcttatttcgttggcagtaatgttgacagcaatcaaattgattttttgtgagttagaaggtagaacggcacaaaagaaaagtattttaagctggtatactaaattaaatgaaccgtttaagtatactcgaacaaaaagtattatctttatgtgtgtgatatgttatgctattgcgtcagttcaggcgatgtttacaactgaatggtttgttgaaatgttaggatttatcgcagttggagttatttgtgatgggattagccagtatattggattttattacaataaaatccgttttaggaagaaaatcaatgaggctttattgatgaaatcagaaattgccaaagcgatgaatgaaacagctaatgcgctggtacagcaaagtttaccaacttattcaagccatgagattgccgcccgttattttaatgatgacactcatttagcgactatctcatttgatgggggagaatatgttgctgcttttgaacatttaccaccacttacatatgttgtagaagctcaatatgaaaaagctgaagaaaaattagctgatcgcaatgttaaagtaacaaaattaacaaatgaagggaaattaccatttaaagatgagcgaatcgatgtcattgttaatgaattatctaattatgataagtatgatttgtatcgggtcgtaaaaccaggtgggtatattattgttaatcaaatgggtagtgataattataaagaattgatcaatattttcttaccttttaagttacatggtcgttgggatcgtgaggctagttgtcagacattgagtgacattggtttggagattattgatagtgtggaagaacatgggtatgttcgttttgacacgttggcatcatttattcagttcatgaaaggaatcactaaagctgatattactcaagatcgttttatgaatttttatagtcatgtgttgaaacagatcaaagataagaaatattttgaattaacgactcatcgttttatggtagtggcaagaaaaaaagagttataagagtatggttaaattgaaaaaaattttcaatttaacctttttttatggagaaaaattaattattacgaaaaatgataattaaactaccagacaattttttaggagagttttatctgcgctatgaacagaaggtgtttataacgttggcagggttgtctaagatcatattgagatatgtaagtctgtgactagaaaattattgctttttgtaacgatgttggttcacgtatcagaaataatatgtactgctgttatgaagtggatattaagctgtttagaatctcattgccggaggagtaatgggtaactgattatgggcaaacgcttaaaaaaatgtcgtaaattcatatttaaaattgtattaaaggatttttttacagtattgatagaataaaaagagatggttttatgattgttaagaaaaaggctttaaatctaaaaagatttaggagctgataaggtaggtatacttccaatctcgacactaaaagaattgttaattagaatattatattattgaatttaatatacaacattaaattcatgaagtaacatggctaaacagtaattaaatcaaatatcaagcaaggttaagaaaagtatcacttgtcacaccgtatgatcaataaacaaaagatgcaagttatgtagctaatacaatgcggtaaaattatcaagatgagttatttagagattatttaaattagattgaagaaaatagttaataaagatgatgaggttatttttattcatccaataatgctggcaggagataataaaattaaagatctagtattttaaatcagatcattagtcgaaaaatggaagtttaacttccatttttgattctttattgtataattaaagtaatttaataacgcatatttaatggttgttgtacattaataaggaatcttgttagaagcaagagcggtcccgccgccgtaatgaggagttaagacgatagaccactggtgaaaactgggaaggtgttaagacgatgaatctaagccggaatacttgccattatcttaggatacactttacggacgatagagtagttctacataaacgtgatccttttgtgcgccattttttagaaagggtcttttattatgtcaaaatatttaaaaatttcattagtatttatcttggttttattgactggatgtggaacagtaacaaagggcaataatattgtgaaaaccaaaacagaatcaactgaacaacaatgggctaatgaggtgacagcaacaattgatgcagctggtaatgtaacagtcataagtgaaaatagtcagacagatagcgctacagatgctggtgatgagcataataagggaacaaatagttctgctttagattctaatcagacatctaatgatggtgctaatactgatgctggtaataaagataattctccaaataataagccagctgataatgataatcaaatgattaatgttagcatttcaattgattgtaaaacaattttaaataatatggataaaattagtgatggatataaatataatattaatattccttcttctggaattattttaccaaatacggtatataaggtgaaaaagaatactacagttttagaattattaagacagattaatggagagaaagaattaaaattggtcgcaaatagtggttatgttagtagtattaaggatattccgcaattttgtgttggagaaaaaagtggttggatgtatagtgttaatggtaaatatgtaaatgtcggtgctgggggaaaaaagttaaaagatggtgatgcagtcaaatggatgtttacatgtgattatgggaaggatttatcatggtcttaaaaccatttagaagtagtcatccgctagtattatttgcttattttctttcagttatgatagtgtcaattattcaacagaattattatataattgttttagttataatatgtgccttaattatggattattattttaacgcaaaattattttttaaagatattaaatatacaataattttaattattattgtaacaattactaatcctttatttgtgacagaaggaacaaatattgtataccaaaatgattatgtaacaataacaagtcaagcattaatttatggttttgtatttggtttattattaagtagtatgttgttatggtttcgtgtaatgaaaacatgtttaacagatagccacatagtttatctatttggctcaattttgccaaccttagggctagtgatttcaatgagctttaacattattagtaagttgaggttacaatatcgaaaaatcaaagaagctaatataaatatgcccaatcaaaataagttgggttactaccgaaatctgatagttgtattagttacctatgcttttgaatcttcgctagatatgatgaattcaatgcaagctagaggatatggagatggtaaaagaacaagttttcatttgtataaatttagaagagacgataaattaaaattatttgtgattatcattttaacattaatttgtttatatagttattttagtttatatcataatttttattattatcctatcgttcaaacgtattatttaaaatggcaagatggtttatttatgctagtttatataggattaatgttattaccaatttatttaggaggaaagaaaaatgtataaagtaaaaaatgtatgttttacttatcctgataatgaaaaagtgattgataacctttcctttgaaataaataaaggggattttgttgttatttgtggcgagagtggttgtggcaaaacaacattgttgagattgttaaaatcaagtttacaaccgacaggaacacttgaaggaacaattgaactagacgaacaaataaaaaaagatattcagattggctttgtttttcaaaaccctgatgatcaaattgttatggataaggtttggcatgaaattgcttttggacttgaaaatcaggcaatccccttaaaacaaatgaaacgtcgagtaggtgaaattgttaattattttaatttacaaaatattattaacaatgatacacaatcattatctggcggagaaaaacaacttgttaatttagctagtgtaatggtaatgaatcctagtgttatcttacttgatgaagctacggctcagttagatccagttaatcgtgatgaatttattagaattttaaaacagctaaatgatgattttgatattacgattattttagttgaacatcaattagaaggcttgttggatgttgcaaatcgtttgattttgcttgatcatggccaaaaagttattgatgatcaaattgaaaaggcagtaaaaaagatgttaacagaggatgtttttgtagctgctttacctaattatgtacgagtttcaacattagctaatgcactttgtttaactgtaaaacaagcacgtgaagcactaaaagactatcatgattttgatattaaggagcaggaggttgtcgatactggacttttattgaaaattcgtgatttgagctttgcctacgatagtacggttttagaaaatcttgatttagatgttagacaaaatgagatattatcagtagtaggagctaacggtagtgggaaatcatcatttttgaaatgtatcgcagggttagttaagtatcaaggtaatataactaaagtaggagttgtagaaaaaattggttatttaccccaggatcccacaacattgtttataaccgataaagttataaatgaattattagtagtagaaaataatttaaaaacagttgaaattgaaatggagaatattggaattagtaatttacgagatatgcacccgtttgatttgagcggtggtcaaaagcaattattggcattaggaaaagttttactgacaagaccgcaattgttgttattagatgaacctactaaaggaatagatgcagtgagcaaagataatttggcgagtttgattcgtagtttaagcaaacatatgacgataattgttgttagtcatgatttagaatttgtcgctaaaataagtgatcgagttgctatgatttttaatggacaaatggaatcagtagactcgatgcgaaatttctttagtaataatttattttatactacaacgattaataaaatagtaagaaataataactctgaagttgttttattagaggatttagggttatgaaaataaaaaaaagtatctttattttaatggttattgttttaataacgatcttaggaactgttttatataaaggtgaaaaatataatttaattattattgcttcgttcgcattatcttgtttaccattttattttaaatatgaaaatagcaaacctaaaataagggaagttgtggttttggcaacaatgattgccctaacagttgtttctagaacgatttttatgttaacacccagttttaaacctgtaactgcaatggttattatttgtgggatagtttttggtccggcatctggttttatgtgtgggtcgttgtcagcaacattatcagactttgtttttggaataggaccatggactccattccaaatgatcgcatggggaataattggttatggagctggaatttttagtaaaaatttgtttaaaaataaatttttattatatggatatagtgctatttgtggacttgctttttccatggtaatggatttatggtcagttcttgcttttgaaacaagttttaatttaacacgatatttggcaatagtattaacttcattaccaacgacgttaatatatattgtttcaaatataatttttatgtttttacttagtaagacgatgtttcagatcttacaaagggtaaaaataaaatatggaataacggagggaaatcaatgaagaaaaaagttttaggtttattaacaagttttgctttagtgtttattagcataacaaatgtgttcgcggttggacaagaggcaggtatgctacagtcttacttaaaaaataattatgaaagttttttaaattcagatgcatatctcgattatcgatatatgacactgggtttgggtagcatgcaagtttttggtgatgatcaagtagatatttttaaaataaaagattatgattttaaaaatgaatatgcatctaatttaggaatggatattgcagctttaataagtattggtattaaccctaatcaagtaacaaatagcagtggtataagctataatctagttagtatgttagaaacatatgtaagggaaaatggcgcagtaattaaggatgaaaacggattacagcctacagctttacaacaagcattagcattaattggtcttgaaacttcgaatgctgagtacaataaagaagctgcagctatgtatttaattggacaacaagatgaatctggttcctatatatcttatggtgataagagtccggatgtaactggttgggctattgcagcactagcttctataaacaggaaattaaacagtcaagaaattacaaattcaattaataagtcagtaaattggttaatgaaaactcaaaatcaagatggtggctggtgttatacatatggacaaggaatttcaagcgcaagtagtgttgcttcagtattatttggtttaattgaatatgatgctgatggagtaaaaaatggtgattataacaataatgttaatataaatccctatgatacacttcttacatttcaaaatagtgatggatcatttgctgaatccgtaggtggagatgaaaatccttatgcgatgtctcagtgtgcttgggcaattagtgcatatacatatggtccgttaattaggcagttaagtattaaatgtgataaattggttaatggcaatgaagaagaacagactaaaccagccccaatgcccgatcctattacaccatctacacctgctgataagtcaattacatcagttaagacaggtgatgatgcagtcattgcactaacagtatcttcattgattattagtggtggaatgtacttgtttattagaaaagaatcttaaaaaagtgtaaaatgtagtgacccccaaaatgatatgtaccctccttactggtttgtccagtaaagaaggtacacatcaaaaaggaggtcactttttatacggaatagtaaaaaatttaaattaaaatatatttaaaaatataaggatgggaatatctaaaagatctatcgggtgtatgtcataaggatttttgactcaacgagtggaataaaattagaacatataagctgactttatccatcgaacaaaaaatggaactgataaatagagttggaaacagagaaaattatcggttagtagctttagctgccagtataggacgatgtattaataaaaaactgaacatcttagtttgcaattattattcaaaccttaaaggattaatctttcatttagatcaagaatgacattgtcacagcataaagcctatcaaaaatggttaagtgataaagaaaattgcatgaacaattcaaagctgcaatgagtgaatatatcgaatattataataacgagagaatcaatacaaaaagaaaaggattgagtccacttgtatatagacaacaatcctttcaagatctaactttaatttaacgtgtccaacttttcggggcactacaaaagcacttttttatttattatatttttggtggtttttacgatattgtaaaggagaaaaatttgtactttttttaaatgcttgagcaaaatatgaaagcgaggagaaaccaagaattgttgaaatctgtgaaattgataggtcggtatctctaagtaaatatttgctctcatatattcttcgctgaagtagatagctgattggtgaaacaccgacatcatttttaaattcatgagcaagatagaatttattcatatgagttttttcagctaaagtatccaaagttatttctttatggtaattacgatcaatgtagttcttgatcataaagatttccttgcgaatagtcttaccttgtgttaaagatacattaatacgatttaatcttaaaatatttattagtaagacttgcattagttgttggcacatatcatcatatagttcattcttagcttgtgattcttttaccattaaatttaagtaaaaaagaatctcatttttataattagcataattacagctaatataatcttttaaactattctcaggtatttcaaaactaatcccatcaatagcaattacaatatattccaatggatttcgatcacgagaaacttcagtatgcatcgtgttagggttgataataacaaaatcattttcttgaacattaaattcgtctgctccgattttaaagccaccgcatcctttagttacataaaataattcagtaaagtgatgggagtgtaactgagaatgccagtcaccttcatattttgaactactaacatatagtaagcgagcttgattattaattaatgccggcttttcgataaattcaattctttcattgctcataattttcacctcgagtttattataactaatataacgtcaaatttatataaatttttatatttttataataaaataaagcaagatatataaaaaagtaagcaattatcgcgtagtaaaagcgcttacattaaaatataatttagttgtaattaatcataataaacaaggaggaaaacgaatattatgaagaaaattttaagtactgcccttgtattatcgttagcagcagggatgctgactggttgtggtggcgggaaatcagatgacaccaatactttaaaaatttcgggactaaatggtggttatgggacaaaaggatgggaagctgtagttaaggcttttgaaaaaaaagaaggggttaaagttgaattaaatttagaaaaaaatattgctgaaactttaagaccggtaattacttcaggaaaagatgtacctgatttgatttatttatcagtaggatctgaaggtggtttagtagatacaatgatttctgataaagcaatcgctgaaatcagtgatgttttagatatgaaagtttatggtgaagatgtaaaagttaaagataaaattatccctggatttactaattcatttgcaactaaaccatatggtgatggaaaattatatttagcaccatttacttatgatccttgcggcttattctataatgctggtttatttgaacaaaaaggttggacagttccaacaacttgggatgagatgtgggaattaggtgaaaaagcaaaggcagaaggaattgctttattcacttatccaacaactggatattttgatgcttttttctcagcgttattaaacgaaactgtaggtgctgacgcttatactaagttaatggaatatgatactaaaacatggcaatctgctgaaactaaaaaagcatttgaaatagtcggaaaattagcacaatatactgaagctaatacggttgcaaatgctaataaagataatttcacaaaaaatcaacaattaattttagataataaagcattattctgtccaaatggtacttggttgccagatgaaatgtctgaagcaccacgtgctgaaggtttcaaatggggatttatggcattaccaaaagtaagtgcagaaggagattcatattcttctacattctctgaacaagtatatattccttcaaaagccaaaaatgctgatttggctaaaaaatttattacatttatgtacagtgacgaagctgcaaaattatttgctgaagaatctggatgcgttttaccaactacaactgcttcatcatatttaccagaaaaagtaaaagataaagatggtaatgaaattgataatcaaaaaacactattctaccaaatttatgataatggggctaagagttgtacggttggatttaaatctgttgatgcaattgaaggggttgatctaactagtgctgaaggtattctttatggaacagttaattctgttgtaacaggagataaaacagttgatgaatggtataatgctgtgattgatgctgttaaaaaatacgacaaataataattgataaaataatagcggtggtgtcattccaccgctattttagaaagtaggtgcagcaatgaataagaaaaaagaaagacgcagattcattattttatgccttgccccagcggtaatcttatttggagtgttcatgattttgccgacccttaatgtcttttggatgtcaacattaaaatggggcgggctatcagccgataagacttttgttggatttaataattttgtgttattaatgcaagatatgaattttattcgtgctttacaaaataccattttgattattgcggttgtaactgtaattacgatggctgtagcaattctttttgcttcgattttagttagagaaaaaataaaaggacaaaatttctttcgggtaattttttatattcctaatatattatcagtagtcgttatctcttcgattttttctgcaatctatgatccctcagaaaatggtatgatcaatagtgttttaatgttatttaaaccagaaagctgggaaactgttaagtttcttggagatcaaagtattgttatttatgccatcataggaacaatgatatggcaagctataggttattatatggttatgtacatggcttcgatgagttcgattcccgaacacttgtatgaagcttcagcacttgatggagctgggaaaatcaaacaatttttttcaattacactacctttgatttgggataatatccgaacaactttaactttctttattatttcgacgattaacttaagttttttatttgttaaagttatgactagtggtggacctgatggagctagtgaaacggtcttaagttatttatataaacaagcttataacaacgcatcatatggatatggaatggcgattgccgcagtagtttttattttttcatttattttgagttttattattaatcgtgctacagagcgtgatacgttagagttatagaaaggagcaggaaaatgaaaaagttatttagcagtgataaactttataaaatatttatttatgtagctttgattactcttgcggtttctattattgtaccggtagcatgggtatttatggcttcaatcaaagagaattctgagttttatggaaatccctggtctattccggcaggaatctatttgcaaaactttgttaatgcatttgaacaagcgaatatgggagaatatttacttaattctattttaacaacagcgatggcactggtgattttattagtcgtttcattaccagcggcgtatgtattggcgcgttataattttaagggaagaagattttttaacaccttatttatggcagggttatttattaatgtaaattatattgttgtacctatctttttaatgttattagattgggatgattttatttatgaattactcggaggaaatttctttttaaataatatttttgttttagctgttgtatacgcagcgacagctattccgtttaccgtttatttattaagtggttattttaagactttaccaaaggcttatgaagaagcagcgttaatagatggatgtggatattataaaacaatggttagagtaatgattcccatggcaaaaccaagtattattactgtaattttatttaattttttagcattttggaatgaatatattattgccttgacattattaccaagtacttcaaaaacattacctgtaggattgttgaatttgatgcaggcaacccgggggaaggctgagtatggtatgatgtatgctggattagtagtagttatgctgccaacgttgattctatatattatagttcaaaagaaacttacacaaggaatgaccttgggtggattgaaagattagaggagaaaactatggatggaaaaactaaaataattatcatggttgttgtatttatagtttcaatggctttgatttttattggacaaaaaaatgttggttatacaggattagcgactgaactggtgggcttagctggattgatcggagtaatttacacatataataaaggctataagtaaaggagaaacaagatggcgaatttaagcttaaaacatattgataagatatatgataataatgttcaagctgtatttgattttaatctagaaatcgcagataaggaatttattgtttttgttggtccttctggttgtgggaagagtactacacttagaatgattgcgggattagaagaaatttcagcaggagagctatatatagatggaaaattgatgaatgatgtggctccaaaaaatcgagatattgcaatggtgtttcaatcatatgcattatatcctcatatgagtgtatatgataacatggcttttggtttaaaaatagcaaaaaagccaaaagatgaaattgatcaaaaggttcgtaaagcagctaaagctttagatatagaacaatatttagatcgtaagcctaaagctttatccggtggacaaagacaacgggtagcattagggcgagcaatcgttcgagaaccaaaagtatttttaatggatgagccattgagtaatttagatgctaaattaagagttcagatgcgaacagagatttcaaaattatatcagcaattaggaacaacatttatttatgtgactcacgatcaaactgaagcgatgacgatgggaacaagaattgttgtgatgaaagatggtcggattcaacaagtagcatcaccagcatatttatacaatcatcccgtcaataaatttgttgctggttttattgggagtccacaaatgaattttttaaatggtaaaattaatgaaaaggacggtgctattattattgaactgagtgatgttagtttaaaggttgaatcaactagagctaagcagcttagagaaaaaggatatttaggcaagacggtaataatgggaataaggccggaagatatcagtgttgataatgactacattaatgagcatcaggaggattgttttgaggggaaagcagaagtagttgaatttatgggttctgaaagttatatccatatggttaaagatgaaaaaccgtttattgttaaagcccctggcggaacaactctgacaaatggggtaattgggagatttgcttataagatggacaaaatgcatttctttgacatagacagtgaagaagctataattgaaggagagtagacatggaaaaatacgggagattaacgttacctactgatttagatgtaattgaccaaacgattgaattaaaaaataaacttggggctgatgcaattcgagattgtgatgggaccgacatgcctcaagaattaatgaatttggatgctaaaatatatgcaacatattatactacaagaaaagataatgagtgggctgaagctaatccagacgagatccaacaagaatatttgataacggaccgttatactgctcgtgatactagtttaacgattgagttaatgaaaggttttcatactcagcagctgaaagttaatgatattgatgatcctaaacgctggtgggaagtaattgatcgtactactggtgaagtagtagcagttgatcaatgggaatttaataaagaagttggagcagtaacaatttcgactataccttatcatgaatatacagttagttttttggcatttttaatttgggatcctgttcatatgtataattttattacaaatgattggaaagatgcgccgcatcaattaacctttgatgtccgtcaacctaagaccaaggaatttgttaaagataaattacggaaattttgtgaagaaaataaacatgttgatgtaattcgtttcaccactttttttcatcaatttactttaacatttgatgatcaaaaaagagaaaaatttgtagaatggtttggatatagtgcaagcgttagtccttacattttagagcaatttgaaaaatgggcaggttataaatggcgcgctgaatatattgttgatcaaggatatcataattcattatttagagtaccatcaaaacaatttaaagattttattgagttccaacaaattgaggtttgtaaattagctaaggaattagttgatattgttcatggttatggtaaagaggctatgatgtttttgggtgatcattggattggaacagaaccgtatggtaaatattttgaaacaattggtttggatgctgtagttggttctgtaggaaatggtgtaacgatgcgaatgatttccgatattaaaggcgtacgttatacagaagggcgttttttaccatatttcttccctgatgttttctgtgagggtggtgatccgattaaagaagcaaaagataactggttacaagcaagaagagctattttaagaagtccgctagatcgaatcggttatggaggatatttgaaactggcagtggaatggccgggatttgttgatacaattacccaagtagttgatgaatttagacaaattcatgatttaacaaaagaaacaaaagcctatacctctccatttaaagtggcaatactaaactgttggggaagtattcgacgttggatgaataatcaggttcatcatgctatctggtatcgtgaaatttattcttatgtagggataattgaatgtttaagcgggatgccgatcgatgttgagtttattaattttgatgatataaaaaaaggaattaatcctgatattaaagtaattattaatgccggtacggcttacacatcatggtcaggagcagaaaactggattgatgaagaggttcttacaaccattagaaaatggatagataatggtggcggttttatcggggttggagaaccaaccgcttatcaatatcagggaaaattctttcaattaagtgatgttcttggtgttgataaggaagttggctttacattaagtcatgataaatacaatacagttgatcctaatcattttattgttgaagatattgaaggagaaattgattttggtgaaggaatggctagcatttatggacatggtgaaaactatcaaattattcgtcaacataaagagtttgctcaattagttacaaatacttacggtgctgggcgtagtgtttatttagctggacttccttattcaccgcaaaattgtcgtttattattaagagcaatctattgggcggcagctaaagaagatgaaatgaaaaaatactatgtagataatgtcaatgctgaagtagctgcttttgaagcggtaggaaagatcgtagttattaataactcactagatgctctggatacccatctatatgtagaaggaaatttacgagaaaaattaagattagcaccaatggaaatgcgttggcttgatatttaattgaaagactcattttctttgaaagtgggtcttttaaaaggaggataaaaatgaataaaccagtattagtaattatggcagcaggtatggggagtcgttatggcggattaaagcagattgatccaattgatgaggatggtcatataattattgatttttcgatttatgatgctcgacgagcaggttttgaaactgttatatttattataaaaaaggaaaacgaagaagagtttaaagaagttattggagatagaatggagcaaatcatgaatgttaaatacgtatatcaggatttggctaatattccagcggaattttcattaccagctggtcgtgtgaaaccatggggaactgctcatgcgatttggagttgtaaagatttaatagatgggccatttgcagtgattaatgctgatgattattacggagttacagcgtataaacaaatctatgattttctattaaatcatcccgatggggtaaaatataattatgcaatggtaggttattatattgaaaatacattaactgaaaatggtcatgtggctcggggtgtttgtcaggtaaatgataaacaactgctggttgatattcatgaaagaacacaaattgttcgaaatggtgcaggtgcaaagtatactgaggatgatggtcaaagttgggttgaactgcctaaaggaacaattgtttcaatgaatctttggggatataataagagtatcttattagagatagaaaaaggaataaatagtttttttgaaatcggtttaaaagaaaatccgttaaagtgtgagtattttattcctgcagttgtaagtaaattacttgatcaaagtaaggtagaagttacggttctagagtctcaagaacgctggtacggtgtcacttatcgtgaggataaaccaataattcaaatggcgattaaagaattaaaagatgcaggtgtttatcctaagcatctttggaaggagtgatcaatagtgagtgaagagttattaaacgaagtagttgaagcattttcatttgaaggtgtgttgaagaaaaaaaagccttatggaagcggacatatcaatgatacatttttattgacttttgatattgaaagaatgggaatgattgatatcattttgcaacgaatgaatactgcggtttttactaaaccgattgaattgatggaaaatattgctaacgtaacaagatttttacgagataaaattattgctagtgagggtgatcccgaaagagaaacactcaatattatttatactttggatcataaaccatattatgtagattcagctggtggatattggcgagcatacaaatttattacttgtgcaactagttatgatcaagttgagagtgctgaagatttttatcaaagtgcattagcttttggacacttccagagccttttggctgattatccggcagcaacacttcatgagacaatcaaaggttttcatgatactaaagctcgctttgaacgttttaaagaagtagttgccaatgatatttgtaatcgtgctaaagatgttcaagcagagattgaatttgttttagctcgtgaagatgtggcaaatgtattaacaaattgtaatttgccaatacgggtcactcataatgatacgaagttaaataatgttatgattgatgataaaactcataaaggtatttgtgtgattgatttagatactgttatgccgggtttagcagtcaatgactttggtgattcgattcgatttggagccagtacaggggcagaagatgaaattgatttagataaaatcgaatgtgatatggcgttgtttgaaatttatgctaaaggttttatcaaaggttgtgatggtaaattaacgaaagaggaaatcaaagcattaccgattggggctaaggttatgacatttgaatgtggaatgcgttttttaactgattatttggagggtgatatttatttcaaaattcatcgcaagaatcataatcttgatcgttgtagaactcaatttaagcttgttaaagatatggaatcaaaatgggaaatgatgaataaaatcgttgaaaaatatatgtgattatattaaagaaggtaaatttttagcaatatatgggaataatttgtaagcgctaaattttatgtaaaaagttctttaaaaccaaggggttaggtgttataattgatttatagaaattttaaggaggagtcataaaatggcagaaaaattatctttcgtagtatctgatcctgtaggattacatgcaagaccagctactatcttagttaaccaagctagtaagtttacaagcaatattaaattagtatacaatggtaaagaagtaaacttaaaatcaatcatgggagttatgtctttaggtgttcctactaaagctacagtagaaatcgtagctgaaggtgatgacgaaaaagatgtaattgcttcaattgcaaaagttattaaagaacaaaaagtagctgaataagaaaattagaagtcctcggacttctttttatttgcttaaaatttatgtttggattaagataataatgttgttaggaggtttttatggctaaaaaaattaaaactaatgctttacgtttattagatcaagcaaagattgattacgaaataaaggaatatgaatatgatgaagatcatttaagtggtgaacatattgttgcacaagttgaaataccggctaaagatatttttaagacactggttttaaaaggaaaccgtggttttttagtatgctgtataccggtattagaggaaatagatttaaaaaaattggcaaagttatctaataataaaagtgtagcaatgattcatatgaaggatttattagcaacgaccggatatattcgtggaggctgtagtccagtgggaatgaagaaaaaatttgatacttattttgattgctcaattaatgagtgtgataaaattgctctcagtgctggaaaaagaggatatcaaatgattgtagaagcaaagcagttactagcatatttagatgcggtagttggtgatgtgataaggagatagcgatgattcaatgttattatggtaatggtaaaggaaaaactacagctgcagtaggacaagcattaagaatggctggggcagataaaaaagtattatttctacaatttttgaaagacggtgacagcagtgaaataaagatgctgaaaaagtgtggaattaaagtgttgtatgctaaaatgcctcagatgtttattgatatgcatgatccagagatgataaaattggtgagtcgtttagaagatgagttatttgaacaaatagatgaaagttatgaaggaattgttttagatgaaattcttgatgcaattgctttaaatttattaaatgaagggaaagtgtatgattgcttggtaagcttaaaagaaactcacgaggtaattttaacagggcgtcagcctagtcataaattaaaaccgattctagattattcgagtgaaattaagaaacataagcatccatatgataaaggaataaaagcgcgtaaaggaattgagttctaatttgtagtaatttcatttataaaacaagtagttatttttttacaggtttgttataattaaattaagaggtgaaaaacatgaactacaatgaagaatatcaaagatgggtaaattgtgaaaatttagatccatcactaaaagcagagttagcaagtatgaatgaaaaggaaaaagaggatgcattctatatgaacctagagtttggaactgcaggaatgcgaggaattttaggggctggtactaaccgaatgaacatctatacaattagaaaggctaatgttggctttgctaaatatgtattaggtttaccagaaggaaaagaacgtggagtcgcaattggttatgataaccgccacatgtcttacaaatttgcaattgaaagtgcgaaagttttagctacttatggaattaaatcttatatttttgaaagtttaagaccaactccagaattatcttatgcagtacgttatttaaaatgtgctggtgggattatgatcactgcaagtcataaccctaaagaatacaacggttataaagtatatgatgatactggatgccaattaattcctgaatggggagatcaagtagttgcatatgtaaatgaagttaaagatgaattggcagtagaagtaattagcgatgaagaagcttatccatatattacatggatcggtgaagaagtagatgaagcatattatcaagaagtaatggcaattgaaattaatcccggtatggataaaaaagatttcaaaattgttttctcaccacaacacggtacttcaaatctaccagttagaaattgtttgagtcgtttaggctataatgttattccggttttagctcagtgtgcaccagatcctgatttttcaaatactaaatcaccaaatcctgaagttgactgctcatatgatctagcaattaaaaaagctaaagaagttgatgcagatgtcgttgtaatttgcgatcctgatggtgatagattaggtgttgttgctaaacatgatggtgaatatgtattgatgtctggaaatcaaagtgctgcagtatatttagaatatattttaagcgaacttaaaaagcaaggtaaattaccagctaatgcagtaatgtataatacgatcgttactagtgatttaggtgaattggtgtctaaatcttatggtgttgaggttgaaaaaacattgacaggatttaaatttatcggtgataagattcgtaaatatgaaaaaacaaaagaaaaagaatttatcttcggatatgaagaatcttatggttgtgtagttaaggatttcgttcgtgataaagatgcagttcaagcggttgtaatggcagcagaagctggtaatttctataaacatcaaggaaaagatctaattgatgttttaaatgaattatatgctaaacatggtacgtttaaagaatcgcaaattgctttaagcaaagccggagctgaaggtgcaaaacgtattaaagaaattatggataatttaagaaaagatgctccaagtgtgattggaggatataaagtattagcagtagaagattatcaaagtagtcaacgtattgaaaatgaaactacgacagttattgatctacctaaatcaaatgtattaaaatactatttggaagatggatcatggattgcggctcgtcctagtggaacagaaccaaaatgtaaattctatttttcaataaaaggtaatgatgctgatgatgcgagtgtaaaaacagaagttttccaaaaagatatattaagtattattggtgaatagactataaaaagatggactttagagagtttatgctctaatttgagtaaaaactctttagctccatcttttttatttaaaatcagtaaaaaacagtaaaaaaaattattattttactgttttgcttttatttattagtataattttaataagatttaattattttagttaaaatataataaaattaagtaaaaaataagtaaaataatcagtaaaaaatatttacattattttattataattatataatataaatagatataaaaacatcgatgaacaaatatctaaaaataaatatatgaggagaacgaaaatgtatcaaagacttatggatattatgtctgaaagattattgcctattgcaactaaaattggttcacaaaaacatttagtcgcattacgtgattcatttattgcaacgatgcctgtggttatgacgggatcgatcgcattattgttaaatgctttttttgtagattttcctgctgaatttgggtggacaggaatcactgacgcatttcaatggttgattagtattaataatttgatttttaatgggagtttagcaattgtttccttagtctttatttttgctttaggatataatatcgctaaagtatacgaaacagataaattatctggaggattagttgctttatcatcatttgttatttctttaggaacaagtattactcaaacatttcaattagagggtgttagtgctgatattgggaaaattattaatcaggtcactggcttgaattttagtgatggaaatttatcagtaacgatcaatggcttattaccaggaaaccaaattaattcacgtggttattttacagcaattgttattggttttttagcggtagtgatttatagtaaattcatgaagaaaaactggacgattaaattacctgattctgtacctccggcaatctcggtgccatttacttcaattattccggcttttattgctatgtatgctgtagcagcaattacttatggatttaatttggtgacaggtcaattaattattgattggatctatgatattttacagacaccattgttgggcttctctcaaaatccgctttctattattttagtagcttttttaactcaattattttggttttttggaatccacggtgggaatgttatggcaccgatcatggaaggtgtttttggtgttgcattattggcgaatcttgaagctttccaaaaaggaacagaaataccatatttatggacgagtgtatcatatggtgcctttgtctggtatgcaacattaggcctgttaattgcaattttttggcaatctaaaaataaacattatcgtgaagtagctaaattaggtatagctccagtaatgtttaatattggtgaacctgttatgtatgggctgccaactgtcttgaatccgttaatgttcattcctttcctgttggcaccaattgtattgtcagcagttgcttatggggcaacagcattaggattagttgcaccagttacacaaaatgttacttgggtcatgccgccggttctttatggattctttgcaactggttttgattggcgagcaattattttatcacttgtaaatctggctttagctgtaattatttatttaccgtttgttaagttggcaaacaatcctaaatttgaagaaaaataagtggaagaggtaaataatattgggtagtattgaagtaaataaagagtttttcatcaatggaaataaagttaagattatttctggagcagtgcattattttcgaattgtacctgagtattggcgcgacacactcttggatttaaaagcaatgggatgcaatactgttgaaacatatgtaccatggaatctacatgaaccatatcaaggaaaatatgatttttcgggtattaaagacattgaaacatttttgaaactagctgaggaattggaattatttgttatattacgagcttcaccttatatatgcgctgaatgggaaatgggtggtttaccagcatggttgttaaaatatcctcgtattcgtttacgaactaatgataaacaatatcttaaatgtctggatcaatatttttcaattttattacctaaattaagtaagtatcaaattactcaaaatgggccgataatattggctcaattagaaaatgaatatggttcatatggtgaagataaagaatatttattggctgtgtatcagatgatgagaaaatatggaattgaagtacctctctttacagctgatggaacatggcatgaagccttaaatgcgggttctttattggaaaaaaaagtttttcctacaggaaactttggatcacaagcaaaagaaaatattacggtgttaaaaaaattcatggaatcccatcaaattacggcaccgttaatgtgtatggaattttgggatggctggtttaatcgctggaatcaagaaataattaaaagagatccccaagaatttgtaaattcagcgcaagaaatgttgtcgttgggcagtgtcaatttttatatgtttcaaggcgggacaaattttggatggatgaatggctgttcggctcgaaaagaacatgatttgccccaaataacttcatatgattatgatgcgattctaactgagtatggtgctaaaacagagaaataccatttattgagagaagtaatcactggaaaaaaagagcgtttaccagagcggcgtcaaactaaaaattatggtcaaataataaaaaatcgaagtgtctctttatttagtacgcttgattgtattgctgcctgtcatcagtctgattggcctttaacgatggaagagttagatcattattatggttacgtggtctatcaacatacttttaaaagttatactgatgatttacggatgcgaattattgatggacgtgatcgagcaaaaatatatctggatgatcaagagattgctactcaatatcaagaagaaattggtgatgagattaatttaccgacacatagcaatgatactcatgatttaaagatattaatggaaaatatgggtcgggtcaattatggttctaagttacaagctgagacgcaacaaaaaggaatccgtaatggggtaattttagatatccattttaccaaaaaatggaaacattactgtcttaattttgagcatcttgatttattgaactgggaaaatggttatcaatcaggcccaggtttccatgaatatatttttgaagctgatgaagttaaagaaacttttattgatttggaaggctttggaaagggtgtggtctttgtaaatggtcatcattgtggcagattctatgaggctggaccaacactatcactatatataccaggtccgtttttaaaaaaagggattaatcaaattattatttttgaaacagaaggctgctatcgtgacaagattgaattaattggtcagccaaaatatctataaacagtagaagtattctgattaaaagaagtttaaattctagacaagtgaatttaaactttttttactaataattttaatgagaaatgattattaaaagaatatctagaaattatgatagaattcacttataatactatgaaagagctgttttatcgattgaggagggttaatatggctacattaaaagaggttgctgaatttgcgaatgtttcaatcgcaactgtatcacgaatattaaatgatgataattcattgactgttttaccagaaacgaaagaaaaagtcatcaaagcagctgaacaattaaactatattcctaaatcaaaacgtaagggaaatcatgatgaagctttgacagtggcagttatccagtggtattcttttgaacaagaaatgcgcgatacatattatttatctttgattcaaggtgttgaaaattatttaaaaacaaatggaatcattgctaaaagaattagaaaagacgatatggatttaaataaggttttggaaaatgttcaaggaattatctgtattggtaagtttgaatttgaagtggtaaaagaattaaaggagtacactgaaaatattgttttgttggatatggatatcagccctgtaactgaatgttgtgtaactttggattttgataacgcaatgtttcaggtggttgattattttaaccgtttaggtcataaacatattggttttttaggacggggcgagtacgaagaattatcacttcatattagtactagaaagagtagttttattaaatattgccagtattttggcttgaaatatactgaattgctgctggaaaatgaattaacgagtgaagctggctataatttgatacataatttagctaaaaccgaggaacttccaacggctatttttgctgtcaacgatccaattgctataggtgcaatgcgggcattacaagatcagggaataagagttcctgaacaagtttctattattgggtttaataatattgaagctggtaattttactacaccatcattaacgactgtttatgcgccttcaaaggagatgggaaatcttggtgcgatgctgttacatgaaatgattttaaagaaaaaagctttatttccgatgcgagtacagttgccatgctcgttactagaacgtaaatcatgtaagaaaattatataaaattagtgttattaggatagtttttgctgctgtggtcttaaaatcaagaatgtttgattattaggccgctttttttattttacttaaataaatgttgaatttagtattatattatcaattattggcataatgaaagcgctatctttttaatgaaataccagataaattatgttataatgggaatatctaagaaaagggggagtgacacatgctcgatgattttttaattcacgtatttcacaaaggaaatacattagaagcgtataaagtatttggtgctcatttagaaacaaatgaccacaaaaaaggtgtccgcttcaccgtctatgcacctaatgcacgaagtgtacaagtcgtaggtgattttaatgactgggatgggcaaaaccattatatggaaaggtatacagatggaggaatctggactttatttattcctggggtaaaagaatttgctctttataagtaccggattgaaacacaaaattttgcgacagtagatcgtgctgatccatatgcgttttatagtgagttacgaccaggaacagcgtcaagggtttacaatattgaacggtttcgttgggctgataaaaaatggcttaatagccgaacaaagaattttgataaaccaatgaatatttatgaagtaaatattggttcttggaaaatgaaaaaggattttacggcagaagaagacggtgaattctactcttatgaagagatgatagagcttctaattccatatttagttgaaaataactatactcatttggaattaatgccactgacagaatttccgtttgatggttcgtgggggtatcaagcaactgggtattttagtataactagtcgttatggtgaaccgaaaggtttaatgaaatttatcaatgcttgtcataaggcgggaataggtgtcattatggattttgttcctgcacattatgtaaaagatggacatggtctttataagtttgatggtggatttgtatatgattatccagatattaatcgtcgttatactgaatgggacagtgtttattttgatgttgggcgtgaagaagttagaagctttttaatgagtagtgttggctttttagctgaatatttccacattgatgggatacgttttgatgcggtaagtaacttgatctattggaaaggcaataaagaagctggagttaatgatggtgcgttagaattcatgaaacgtatgaataatcatatgaagggttattatcctggtgtgatgttgattgctgaagattcaagtgattttaatggcgttacaaaagcaccagatattggtggccttggatttgattataaatgggatttgggatggatgaatgatactttaaaatatatgaaactagatccagtttatcgtcaaggtgatcataatttactaacgttctcgatggcttatttttatagtgaaaatttcattttaccattttctcatgatgaagtagttcatagtaagggaactatcattgataaaatttggggtaataatgaacaaaaatttgcccaattaaaaacactttatacttatatgatgattcatcctggaaagaaattaaatttcatgggaaatgaattgggtgaatataaagagtgggatgaaaaggtagctttaggatggaatattcttaagtatcctattcatgattcctttcataaatttatgattagattaaatgaagtttataaaacatatccatgtatgtatgaacaggattatggaatggatggttttgaatggttagttgttgatgatcgagcacaaagtgtatttgcaattgaaagaaaaggaacggatggaagttctttaattgctgttatgaattttacaggaaacaaacatgagggatatatggttccagtaaatcagccaggaagttataaagaaattttaaatagtgatactgatatctatactggaagcaatttcgttaataaacgggctataaaagctaaagagggtcaaactttaaataaggaatattacataccagtaaatattgcgccatttggcagcatgattttcgaatataaaggctctaaataatgaactggtataagaggagataaaatgtttaagaataaagaagaatttaaatttgaattttcaagaagaattatagaatcttatggacgaactgtagaagaagcacatattactgaacgcttcttagttttggaaacaatggttcgtgactatgcttcagtaaactgggcgactagtaaagcgattattcgtaataactatcaaaaacaaatgcattatttctcaatggaatttctaatgggacgattattagtaaataatatgatgaacttaggaatatatcagattgctaaagatggtcttgaagaatatggaatcaatattcatgatttagaggagcttgaaacagatgctggtctaggaaacggtggtcttggaagactagcagcttgctttatggattcattggcttcactagcatatccggggcatgggcatacgattcgttatgaatatggattatttaaacaaaaaattgaaaatggttatcaaatcgaattaccagatcaatggatgcaaacaggatttaactgggaagtgagaaagccgaaacatcgagtaccagtaaagttctttggtaaaattatttttaatgaaacgacagggaaatatgaacatgttgatgctgaggaagtgtacgcagttccttatgatgtccctattgtcggtaatgatactacaaatactaatacgcttcgtttgtggagtgctgaagcaagtgataatattcctgcaaatcaagattttaggcaatatatccaaaatgttagagatatttgtcaaatgttataccctgatgactcaactcctgcgggaaaaatgttgcgtttgaaacaagaatatttctttacttgtgcaggattaaattctattgtaagggcgcatttaagacaatatccaaatttgaataatttccatcaaaaaaatgttatccaattaaatgatacacatcctgttttagcaattcctgaattaatgcgtattttgattgacgaacaaggatatgaatgggaagaagcatgggatattacgacacagacgtttgcttatacaaatcatacgattttagctgaagcgcttgaaacatggccaatcagtttaatgcagtcattattgccaagagtttatgaaattattgaagaaattcatcgacgttttattgggtatgttaaaatggcaagtgaccgtgatgaagagttattgaatcgagtaatgattttacgcgatggtacagtctacatggcgcgacttgcaattgttggaagttttagtgtcaatggggtggcaaaattacattctgatattctagcggaacgtgaattaaaagattttgcacaattatatccatcaaaatttaataataagactaatgggattacacatcgtcgctggttagcatattgcaatccagaactatcatcattaattagtgaatatatcggagatgaatggatcaagcatccggaaagattagaagatctaatggggcatttagatgatcttacccttcaagatcgtttcttggcggtgaaaaaagaaagaaaacaaattttagctgactatattaaagaacataacggaattactgttgatgttgacagtatctttgatattcaagtaaaacgtcttcatgcttataaacgtcaattattaaatattcttcatgttattgatctgtatttaagaatgaaagaaaatcctgattttagaattgaaccgagaacatttatttttggggcaaaagctgcaagtggatattattttgctaaaaaagttattaagttaattaatagtgttggcgatgttgtaaataatgattcggaaactaataaatacttaaaagtagtctttttagaaaattacggagttactttagctgaaaaaatcatgccagcggctgatgtatcggaacaaatctcaactgctggtaaagaggctagtggtacgggaaatatgaaatttatgatgaatggtgcgattacattagggactttggatggagcaaatgttgaaattgcagaattagttggtgaagaaaactgtgtaatctttggaatgaaagatcatgaagttaaagaattacaaatgagtggtgcttataaggcatgggattattataataataatccaagattaaagagaattatcgatagcttgatggatggtacattccatgagaatcgtgaagaattccgggttatttttgaagagttaatgaataaaaatgatgaatattttgttttggctgattatgaagcatattgccaagctcaaagttctgtgcgtgatctatataaagatcgttcaagatgggcaaaagtatgtctaacaaatattgcaaagagtgggttcttctcatcagatcgaactattcaacaatatgttgacgatatttggcatttagataaagtaaaattttaagggattgaaaatccctttttcttttgattaaaattggtatataagttattgataaaacccaaattatctgtatatagtctaaaaaaatgctgattatctacattttatatcattgctatctgagaagtgataggatataatgaacacgagatgaaagggtgaaaatcatggaaaaaagtgccattagaatgattgcaaagatggtatctgtaaataaaatcgaagtacaattgattagaagatattacgaaggaaattgtcctcgtttttatttgagagatttaaataataatactttgatagaaatagaaatatccgctaaatttgtagaagaagaatacgttcattactatttcgataatgtcgaaatagatttttgtcatgtttatcaaattgtagatgcatatggtttagcggaaaccctccaatatactcaactgatctatgatgctgagtttttaaaaaataactattatgatggtaatgatttaggaaattcatatcatgaagattatacgatttttaaagtatgggctccaacagcgttagctgttaaagttgcaattactaaagaccatactacatatagttatgaaatgaaaagaattggtaacggtgttttttgttcatatgttgcgggaaattttgataactgtgagtatgtttatctagtacgacatcatgatagttatattaaggcattggatccatatgcttatggatcttcatcaaatggtaaaagtagttatattgttgatttaaataagattaagatcgacctgaatcgggaatgtttaaagccattaaaaaataagacagatgcgattatttatgaagctagtgtccgtgattttacgatgtatgaaaacagtttaagtaagtacaaaggaaaattcgctggaattagagaaactgggttattgactaaacatggtaatagtgcagggttagattatttagtggaattaggaataacacatatacaattattgccaatctatgattttgcgactgtcgatgaaaatcaccaggaagtactatataattggggatatgatccagctcagtataatgttcctgaaggaagttattgtacaaatcctaatgatggttacagcaggatcgttgagtgtaaacagatgatagcagatctgcatgcgaaaggaattcgggtagtgatggatgttgtctataaccatatgtatgatgttaatgcgagtgcttttgaacgaatcgtacctggctactattttagaaaaaatccagatgggagtttatcaaatggttcatggtgtggtaatgatttggatagtggtgaacatatggtgcgtaagtatattatagatatgtcgagacgctggcaaagtttttatggtgttgacgggtatcgttttgatttaatgggaattattgatattgaaacgattaatcgtgtctatcaaatttgttctgcttacgatgcttcatttatggtttatggggagggttggaatatgccgactaatttaccagatgagcaaaaggcgatgcaggataatcatgcaaaaatgccgaaaattagtttttttaatgatgaatatcgtgaggttattaaaggtggaagcagtgataatgttttagttaataaaggttttattacgggaaatctttacgaaacagaaaaggcaagaaatgtaattacagcgactaatcgttatacaagtccggaccaatcaattaattatgttgaatgtcatgataatgcgacggtttttgataaattgtatatttctaatgttgaagaaggtttagatgggataataactcgacaaaagaatcttacgatcatggtgttattgtcgcagggaattccctttatccatgcgggacaagaattttatcgaactaaaggcgggattgggaatacttataattcacctgataatattaactgtattaattgggattttcgagatatttataaagatgatattaatgagataagaaaaattattcaattacgtaaagataataagtgttttcgctatgcaactagaaaagagattgaagcaaatgttatggttgaaaatattgactttaaaatgttaaaatatactctaaaacaagatgaaggtgaatatcgtgaatttgttatttacattaacccatcaagttttacatttgattatgaagaaactgcttatcagcacctttatggtgaaattactgatcagcaaataggagctagaacgattgttgttctagcaagataggagaattaaattgaaattaattgtaggattgggaaaccctgggaaagagtatgaaggaactcgtcacaactgtgggtttatggtagtagatgaattagctaataaattaaatacagaaataaatcagaataaattcaaaggtttatatacaaaggtaaaatatcatggagaagatgttattttattaaagccgcaaacatatatgaatctttctggtgagtcagtaattgctgcaatgaatttttttaaactggataaagaagatattattgttatctatgatgatctggatatgccggttggtaaattaagattacgtaaaactggcagcgctggggggcataatgggataaaaaacattatcgctcatttatctagtcaagattttaaacgaattcgtgtgggaattgatcgtcacaagtatatgaaagtagttgattatgttttatcaaggtttgcaaaagaggagactgaagcaatcaatcaaggaattgataaggctagtgatgctgttttggattatcttgatcatgattttgattacattatgaatcgttataattagaggtttatatgaagaagatagatgaaatattgaaacaaaaccctgcctttaaaacattgttaaagggagaggggaatatcattgttaatgatcttaacgatgaggcactattagtaactagtgcctttttgacattacaaaaagatattattgtaattaaaccaaatcagtatgaggctaacttgttgtatcaacagatttcattgattaatgaaaaagacagcttattttttccagttgatgagtcatatcgaattgaagctttagcctcatcgccagaactattaggacagcgaattgatgctttatatcaattgacaactgatcagcctaaaattttaattactcatggacaggccctggtacggtatttaccaagtagacagttatttttagataattgtttaaatctaaaaacaggaatgcaaattgatatatatgatttgcaaaaacttttgatcaaggctggttatacatcggcaccacgagtagatcagccgttttatttttctaaacgtggtggagtaatcgatgttttttcaattcaatatgataatccattacggattgaattttttgatgatgagattgataatatacgtttttataatcaaaatagtcaaagaacgatagaaaaggttaaagaagtaaccattattccagctagtgatattttatatgatgaacaagaagtcccggctgttttaagtaaaatcaatgatttaagagaccggcagattgaagaacttgatgagttatatcaagaagattatttaagtaaagtatcaatagatcaagaaaatttgcggaatcatgatactagttttacgatgtatggttattttaatttatttaatcagacagctagtttattagattatctcgataccccgctaatcatccaagcaaacaatcatgatattaattttgcttataagaactatttagaagaaaatcattattattatcaagaattggctagtattgggaaaactattaaaggtttgaatctatttagagatttatatgaagtgattgatagaaaatcagttaattttaaaccttttgctcaaagtgataaagatgtgttgtttaatgctcgtgctattatgatcaataatgatgatgaggcaatgattattaatcaaattagagcttatttaaagttatcaaaagttgttgtagctttagatgatgatcatcaattaaaattaatgactgaattatttgatcgtcatgaaatggcatatactttgattgggataaaagatgaaatatatccggggttgaatattgcggtaaataaaattggttttggaatcgaattagttgatgaaaaaattgttattataagtgcaaatgaattattcaaaacacgtaatattaaaaaaccaaaatattttaagtataagaatgcaaaggttttaaaagattatcaagaattaaatattggtgattatgttgtacatgataatcatgggatagggcaatacttaggaattaaaacattagaagttcaaggatttcataaagattatttatatgtagcctatgctggagacgatactttatatataccggttgaacaatttaagatgattaggaagtattcaagtaatgagggtaaagttcctaaaattaataaattgggaggctcacaatggcagaaaacaaaagccaaagcacggagtaaagttgatgatattgctgataagttaattgaaatttattctgctcgtattaatcagcctggctatgctttcccaagtgatagtgagattcagctggagtttgaacgctcatttggttatgaattaacagttgaccagttacgttcagttgaagaaattaaagccgacatggaaaagagtcagccgatggatcgcttgctatgcggagatgttggatttgggaaaacggaagttgctttaagagcagcatttaaggctattctaggaaataaacaggttgcttttttgtgtcccacaacaattttatcaatgcagcattataaaacaatgattgcacgatttaaggattttcctgtcaaaattgctttattgaatcgctttacatcgactaaggaaaagaagcagatactaagtgatttaaaattaggaaatattgatctgcttgtagggacacatcgaatcttatcaaaggatattgtttttaaagatattggattattatgtatagatgaagaacagcgttttggtgttaaacaaaaagagaaaattaaagagtatcgtaaaactattgatgttttgacccttacagctaccccgattcctcgaactttacaaatgtcattgatgggaattcgcggattgtcacaaattgaaactcctcctaagaatcgtcagccagttcaaacatatgttattgaaaaaaataatgttttaattaaacagatcattgaacgagaattagctcgtgatggacaggttttctatttgtataaccgaactagtcagattgctaatgttgcttataatattactttatcagtacctggggcaagggtagcggtaggtcatgggcaaatggataaaaatgaattagaagatgtaatgatgcgttttgtgaacaaggaatttaatgttctcgtttgcacaacgattattgaaacaggaatcgatattcctaatgcaaatacgattattgttgaagacgctgataaatttggattaagtcagttataccagattaaagggcgcgtagggagaagtaatcgtggtgcatatgcttatttgttatataatcctactaaagttttaaatgaagaagctagtaaacggcttaaggcaattaaggagtttactgaattaggaagtggatataaaattgctatgcgtgatttagcaattcgcggttcaggagatattttgggtggtacacaatcaggctttattgattcaattggttttgagatgtatatgaagattcttcaagatgctattaacgaaaaaatgggtaaagaggatgtggaagcagaaaaagaaatcaaaagtgttaatgtcaaagttgatggatatattcctcatgattatgtatctagtgatattgaaaaacttgaactatatcagcgtctagataatgccaaaacgataagcggtgttgatcatctaaaatcagaatttattgattattacggtaaattaccagaggaagtaagtacattagtagaaaaacggaagttagatattttagcatctactgaaattattgaaaacttagcggaagttaaagggaagatggaaattacttttactaaaggatatagtcaaaatgttaaaggggatcaattgtttgaattagtcaatcgacttttcactaaacctgtgtttaggcaattaggtggtaaaattgtaattgtcttgccaaaaggtgatcaatggcttgagcgaatcaatcaattgataacgacattaaacagttagcaaacagagtattcttgaatagggagatttgtttttaaagcaaatctcttttttttgttagaaaaactaacaaaaaatgaacaatgttcattgaatgcttgttgatgatagcatataataagtgtgaaaagagatgatgagatgactagtcagcgttttaataaaacaattgaacgaaaaaaagagattatcaaagctgcgatgcaattatttagtgaaaaaggatacgcgcaaacatcaatgcgtgatattgctaggacaatgggagtttcgttaggtttgtgttatcgctattttgattcaaaacaaatactatttaatacagcaatcgatctttatattgaagagtgttgtaatagttatcttgctattttacatgattctactattacgattaaagataagatagatgcattatttacttcaataggtgatgagcattcaaatatgcaatattatgatttttttcatcgtgttgaaaatgaagaattacatgaacaattatcaatcaaattatgcaaatatatgtatccacatttattagaagcagtaaaaaaagctattgcagctaaagaaatatatattgaaaatcctgaggcattaattagttttattatatatggtcaagttggattattatctaaaagtaatattgatcatcatgaagttgcaaaattattgaatcagtatgttaatcaattaatgaaatttaatccctgactctagggattaaaattaaaacaaaaaaatgaacatcgttcatttaaggagggcattatgaataaaaaagaacaatctagacaaacatttgacttacaggcttcaaaatatgatactactttttatggaaaacatgcccgtaaaatttatccatatcttttaaatgaaattattcgctgttatggtgaggaagtacttgatttaggatgcgggacaggagctttaatgaaacaagttattagtgaggattcacatcgacatcttacaggaattgatttatcatcacaaatgattgaaaaggctaaacaccaacttaagaataaggcgactttagtagtaggagatagtgagaatttgccattttttgatcaaacttttgatattgtttattgtaatgattcatttcatcactatccaaatcctcaaaaagccattgcagaaatatatcgtgttttaaaaattgggggaacattgattattggtgacacatatttgccagtcattgctcggcaggttatgaattattttattcgctttaataaagatggggatgttagaatttattcaaaaaaagaaatgatttcgttcttggaagaattatttcatgaaataaaatggataaaggtatcgaatagtgcttacatgatcaaaggagtaaaataatgatacaagcaacaaatcgtaaatatttacgatatatttatcaattattgttggagggaaaaaaggtacgtcaaattgatttggctttatctctaggatacgcacgttcaagtgtttcaattgcaattaaacaattgaaaaaagcagggtatattgatcttattaaaaataacattactttaacagagcggggaagtatgttggcacaagaaagtttgaaaagttatcagcaagtttatcgatggatattggctttagggttaacttcatatgaagcaagattatatgcggataaattagaaagtgattttgatcaaaaatttattgagatgttacttaaagacaaaagactaaacaattaattgtttagtctttttgtgaactgtaatttgctaaaatcgtatcaaaatcaagaccgattttaaaacctaatgtaaaataatcatcaatacagttttggaatgcttcaaaactgtaggtttcattaactttcaatgcgctttgataaaccttgattagttgattggcaatattgttggagttgttgatttcttgatagttcttgagtttgtcaacgtgcaattcaaatccgattgacatcaacatatgaagggcatcagtataatagttaaggatttctttgttattggcagatgaattatcccaaaagctaaatacttttgcttcttcaccgactttacctaattcacaaagaaaagctagtacttttgcttcaaccttatctttatttaaaacagcatgattaggatcaacgaccaattttaattcgtggctcatatgcgcttggtagattttattaatttcattcatttaattatcacctcttaagtattattatactcttttatgtgacattttcatgaattatgataattcaatataatcatgacgcaaatattcttttgtataggtattattggttagatcttgaataatagttagaaaagattcattttcaagataacaggtataactaacccgatctaaatactcggtattaatgcatttaatatgatgtactttaattaagtgttcaaattttttagtgtatgaataatccactgtaattttatataaaggaacactgaatttttctacaatctcagctccttttaaagcatcagcaacactttgacgataagctcgagttaaaccgccagctcctaatttaatcccgccaaaatatcttgtaacaatagcaatgatattagtaagtttatttttttctaaaacatctaacattggtaggccggcagttccgctcggctccccgttatcattggcacgtttttgggtaccaacgatataagcaatacagttatgagtagcatcatgatatttttcttgatattctttaataatattatcaattgcagtttcgtcattacacggtattaaagtacaaataaattctgattttttaattatccatttatatgtagttatttcacgtactgatttcattaaatccctcatttctttattatcataacacatattactagcaaaagtatgataaatttggtatattagttacgtaattatagggagggcgagaccatgaaaaaaatagctgttttagcagatagtggatgccagttaccaattggttcgttagaagatcaaggaatttatattgtacctttaacgattacaatgggtaataaaacatatttagatttagaagaaataagtgctaatgaagtatttgaaagaatgaataaaactggggaaatggtgatgacatcacagccttcaacaggttcaattcaaaatgcagttcatagaattaaagatgcgggatatgatcatattattgctttgccgattgcaactggattatcttcaaccttgaatggaatgaaattggcttgtgatatggtgggagtaccagttacgttaattgatactaagggtacggctagtaatcatcgctatttaattagggttgctaaaaaattaattgatgatggtaaaagtgttgcggaaattgaaacgattttaacagcaatggttgaggattcagcgactgtgattatggcacctaatttagaccatttaaagaaaggcggacgaatcactccagcggtagcactattggggaacttattaaaaatagtgccggtaatgaaattaaattatgagttgggcggtaagattgatactttagataaagttagaacggtgaaaaaagccaacttaaagatagttgatcatttagttaatgaatgtggattgaacaataaagactttattattgctattgaacatgtcttagttgatgatttagctcatcaaatgaaacaggcgattattgatcgaattggtgaatgtgagattaccgttcgagagttaccagcggttgtaggagcacatatgggtgttggtggtgttggatatcaatatataaaaaaatacgagggattaacatggaacgaataacaagttttagtgttgaccatacaaagttaacaaaaggtgtctatgtatctcggatagatggtgaattaacaacatttgatatccgcatgactacacctaatttagagcctgctttagatcctcgtggtgctcatacaattgaacatatcggggcaacattacttcgtaacggcgaaaacaaagataaaataatttattttggaccaatgggatgtatgacaggtttttatttaattacaaaagaattagatttggctcgagtaatcaaaattgtacgtgaattatttgaacagattgcaaattggcaagaacccatacctggagcgaagatggaagaatgtggcaattactcatttatggatttagaaaaagctaaagctgcggctaaacattttgttactagcgaatggcagcatgaatatcattatttatagttaaattaaaacatgtttcgaattttgaaacatgtttttttatcgagaacatctatttaattttgtcattataagcgtatattattctatagaggacaaatatgtataaaggagtgattcaaaaacaattagaacctgaccaaagaaggtatttggtactaaattgttatgagtaaatgaattataagaaccaacaataattggtagtgttacattttgataaagattagaattttcattggcaataaaactaattatatcgatgttatttttaaaagcattatcgacaatttcaactaatcggggtgtaattccagaattagaaatcacaataaatagggaattatcttgatatttaatatcaagcatttcagtatggacaacattcattgcataaaatccatttagggttagacgctgttgcaaataatcagcaattggagcagagaatcccatcccaaaaacgatgatattatgttgacgatgtttatttaataattcaatgaatgctggaatatattgttcaagatcatcaggagaaaaaagctgggtattattcgatgatgacagctgatagatcatatcactgtagccactaaaaccaaatttattgcaaagacgataaattgcagaagtagatgtgaaattagcgctggccatttgccgaatcgtaatatcttttaaattattttgattatcttcaagatatttaactaatgctaattcaagttcatttaaatcaaatttatctcttaaatgttcgatattcatattatcacctcaattagattatgtcacagattagaaaaaggagcaagtttatggcaaaaacgatgtacgacccatggtcaaagattattacaagaaatggttatgctggagatgaggtaatatcagctttacagaaatcaattcgtcgcagtttagaagaacaggcatgtatgttcgcctatgaaatgtatatttcttcaccggaattattagaaaaaatgtggcgtcgattattaactatttcggtagaagatattggaatgggagatccgatggctgcagtattagtaaataatttatatcaaatgtcaaaacattttgattatgctgatggtgatcaaccaatgtattttatccacgcgattagatatttatgcagttgtcaaaaagatcgttctagtgatttattaaaaaatatctgtattaaatcttttgcgatgggaaaattaccggaaatacctgatgttgctttagacaagcatacagtaagaggaaaagccatggggcgtgattcattccatttcttgaatgaagctagtaaagttattccacaaatggaggtggataacgattataaagaacgctatgcaaaaattcttgaagaatatgatccagagaatgttagtgaaacagcgttcacttttaatggttggcaattttaatagggggataaaaaattgattagtaaattagagaaattattaggaccaattgcaaataaattggctcagcagcgacatcttcaagcaatttcatcgggtatgatgatgtcattaggattaatcgtagtagggtcagttttcttaattattgccaatccgccaattaatttagacttggttgatttgaatacaggaaatatctttttaaagtttttaattagctggaaacaatttgctttagctaattatgatgttttaactttaccatataattatacaatgggcttagttggtttgatttcagcttttggggttgcttattgcttagctgaaagttataagatgaaagcttcggtttatgggataatttcgatgtgtacttttttaatggttgcagctccattaaaggatggagctattacaatgagttatttaggtgcggatggtctatttgttgctttaataatttcattaatatcagtagagatttcacgagtagtcagtcatcgaatagtctttacttttccagatagtgttcctagtgcagtgactaattttgtaaatagtttaatgccattagcgctaaatatcattgttatttatggggctaatttgattttagtagctttatcagggaaaagtatgccaaatttaattatgtcgtttttaacacctgcaatttcaggggttgataatgtttggatgtttatgggaatttatttattttcaaatattctttggatgtttggaattaatggttcttcaattgtatttccaatagtttttgctttggggattgcgaatacgggactaaatggtgaattagtaaatttaggaaaagatccaatagcaatcatgaatttacagatgtttagatatgctttattaggtggagctggtaatactttaggattggttttattaatgtgtcgttctaaatctaagcatattagctcgattggtcgtttaagtattgttcctgggatttgtggaattaatgagccaatcatgtttggggctccgattgtattaaatccaattttatcgataccgtttttagtaatgccgtgtatttcgattggtttagggtatttagttcaaaaaattggattagtttcaatgggatatatagttgatccatcatttacgccattttttgctcaaggttttttgtcagcattggatattcgtaatgtaatcttcatgattgttttgattattatttcagttggagtatattatccattttttaaagtttatgaaaaaaacacacttgcaaatgaagcagaataataaagtggccgatgccacttttaatatggaggaaagatgaaaaataattatgatgttgtggttgttggagcgggaccagcaggaatcatggcctgctatgaactgtatttgaattcctcgagtgcctatttaatttaccatatcccttttgtcttgtaaagccttttttgtctttttttgtaaaaaaataccactccttcaaaaaggaatggtatttattcacctaactagtaaaattacccgatttttttgtaaacatcaataaattcttgagctaagtcaataactaccaaagcagtcattaagtggtcttgagcatgtaccattaataagtttaatggtgctttttctccacgaatttcagcttgaattaattctgtttgagaatgatgagcttcgtttactgtttctttagcttgttgtaatgattcatcagcttttgctaagtcaccagcttttgcatattgaattgcttcaattgcagagctacgagcactaccactgtttacaattaggttaattacgatttgttcttgttcatccattttgatatctccttataacaatgaattttcagatttatatctgctcttatattatacctaagtgaagggtgcttttcaagcggtttcaattattttcaaaatgtaaaaaaagaaagccactaatgtgactttccaaatttctgtaattattattcaataatatcagagatatttccagaacctacagttctaccaccttcacggattgagaatttagttcctttttcaattgcaattggagcaattaattctacagttaattcaacgttatccccaggcataaccatttctacaccttctggtaattcaataacaccagttacgtcagtagttctgaagtagaattgtggtctatagttagcgaagaaaggagtatgacgtccaccttcatctttacttaagatatacacttgagatttgaattttttgtgtggattaactgatccaggtttagctaatacttgtccacgttgaatttcttcacggttaacacctcttaataaaacccctacgttatctccagattcagcgtaatctaataacttacggaacatttcgatacctgtagcaacagtgtttttagtttcatgaataccaacgatttcaagtgggtcatttaagtttaattgtccacgttcaacacgtccagtagcaactgtaccacgtccagtgattgtgaatacgtcttcaactggcattaagaatggtttatcagtatctctagttggagttggaatataagaatcaacagcttccattaattcatgaatagctggaacccattttggatctccttctaaagcttttaaagcagaaccacggataactggagtgtcatcacctgggaagtcatattcatttaataattcacgaacttccatttctactaagtctaataattcttcgtcatcaaccatatcacatttatttaagaatacaatgatgtaaggtacacctacttgacgagataataagatatgttctcttgtttgaggcattggtccatctgtagcagcaactactaagatagcaccgtccatttgtgcagcaccagtgatcatgtttttgatgtagtcagcatggcctggacagtcaacgtgtgcatagtgacgagttgcagtttggtattcaacgtgtgcagtgttgattgtgataccacgttctttttcttctggagcagcatcgatagcagcataatccattgcttgagcttgtccatcttttgataatactgttgtaatagcagcagttaaagttgttttaccatggtcaacgtgaccaatagttccgatatttacatgcgcttttgagcggtcaaatttttccttagccatttaaggttcctcctagtttatatttttgtacatatacattctaatttatttagttgaaaaaatcaataagattttgattggatactagttgtttccaccgtttttcttaataatttcttctctaatagatttaggtactggttcataacgatcgaagatcattgtgtagttaccacgaccttgtgtaaatgatcttaaatcagtagcatatccgaacatttctgataaaggaatactagcttgcactgtaacagcatttcctctttcttcttgtccttcgatcataccacgacgtgaagatacgtcacccattacactacctaagtattcagcaggtgcagttacttctacagccatgattggctctaagataactggatcacattttttaccagcagcttttaatgccatacttgcagcaactttatatgccatttctgatgaatcgacatcatggtaagaaccatcaaataatgtcgctttaacatctaatactggatatccagcaatcatcccagttgcaagagcatcttcaagacctactttaacagagttaatgtattctcttggaacagatcccccaacgatagcatcaacgaattcaaatcctttaccttcattaggttcaaatttgatccatacgtgaccgtattgtccacgaccaccagattgtttaacatatttaccttcacattcagcagctgttttgattgtttcacgataagctacttgtggagcacctacgttagcttctactttgtattctcttcttaaacggtcaacgattacatctaagtgtaattcacccatacctgcgataactgtatcaccagtttcagggtttgtaaatgttctgaaagttggatcttcttcagctaatttagataatccaacacctaatttatcttgatcttgttttgtttttggttcaatagcaagttcaataactggttcagggaattccattttttcaagaataacgaaattcttttcgtcacagatagtatccccagtagttgtatttttaaaccctacagcagctgcgatatccccagcataaactgtttggatttcattacgtttattggcatgcatttgaagaatacgtcctaaacgttctttcttatcttttgttgaatttaatacatacgatccagaatcaacagttcctgaatatacacggaagaaagttaatcttcctacaaatgggtcagccataattttgaacgctaatgcagcaaacggttcttcgtctgaagcatgtttttcaatttcattaccatcttcatcaatccccttaattgaaggaatatcagtaggagcaggtaagaaatcaataactgcatctaacattggttgaacccctttgtctttataagcagaaccacataatactgggaataattctacagccaatacacctttacggatagcagctttaacttcttcttcagttggttcttcttcttctaaaactttcatcattagatcatcatcataagatgcagcagcatctaacattttagcatgatattcgtttgcttgatctaaatattcctcagggatatctttataaattacgttttcacctttagtcccttcgaagtaaacagctttcatcttaattaagtcgatgattccttcgaaagtatcttcagcaccgattggtaattgaagtgcaacaccatgtacccctaatcttttttctaaagattctaaagacataatgaagtcagcaccagtagcatccattttattacagaatacaatacgtggtactccataagtagttgcttgacgccaaactgtttcagtttgaggttcaacacctgcttttgagtctaatacagtaaccgcaccatctaatacacgtaatgaacgttcaacttctacagtgaagtctacatggcccggtgtatcgatgatattaacacggtatccattccattgtgcagttgttgctgcagaagtgattgtaataccacgttcttgttcttgttccatccagtccatttgagaagcaccttcatgtgtttctccaattttatgaatcttacctgtgtaataaaggacacgttcagtagttgttgttttaccagcatcgatatgagccatgattccgatattacgagttttctctaatgagaattcacgagacataatttttctcctttcgttatcatttgttggatattaccaacggaaatgagcaaatgctttattagcttctgccattttatgagtatcttctttcttcttaacagaagcaccagctccgttagaagcatcaataatttcgttagctaaacgatcaaccattgtattttcgtttcttaaacgagaataatttactaaccatcttaaccctaaagtcattcttctttcaccagatacttctactggtacttggtagttagccccaccaatacgtctaactttaagttcaagaactggcataatgttgttgattgcttgatcaaaaacttccattgctgggtttccagttttctcttctacttttttaaatgcatcatataagatgttttgagcaacaccttttttaccatcaagcataatgttgttgattaatttagatacagttttagaattgtacactggatcaggtagaacgtctcttttagcaacttgaccttttcttgccatttaattttcctcctatacttgatttttcttaagcttttggttttttagcaccgtatcttgaacggccttgtttacgatcattaacaccagcacagtccattgtaccacgtacgatgtgataacgaacccctggtaaatctttaacacgaccaccacgaattaaaacaacactatgttcttgtaagttgtgtccaattcctgggatatatgcagttacttccattccatttgataatctaacacgggcatatttacgtaaagccgagttaggttttttaggtgtcatagtagcaacacgtgtacaaacaccacgtttttgaggtgaattagttgttgttggtttcttagctaatgagttaaaacctctgtttaacgctggtgattttgattttgtggttttgtcgttacgaccttgtctaactaattgattaattgtaggcattccttgttctcctttcttccatacttaaacacacgattccgggtgtttcatatttcgtaataaacaacgcgcccctatgcgggcaccgtagttcatattattacaaaaatataaatatgtcaataattttatttgttttttttaaaaaaattgattatatcattaataaacaaaataaaaaccatttaaacgctttttatatttaaacagtttttactctttctttaattttatatctactgaatctaaataacgctttaaagtattcataaatgcttctaaatcatctcttgtcttaacaaccattaaaattcgttctgatttatttcgagactcaactaccgttatcgtttgccttttttcaattgctccagcaattcgtcggaaaatcgaattcatctctaaatctacatttttatgtaaatagactgcatccgttatcaattcagcaatctcttggtaggtaatcacttcgtccaattttcttggttgaccgaaaacccgcagcattgctgcataggtagttaaccagacatctccacttttacgaatttccgctggcaagaatttatttctttcaaccgccttacgaatcgtattgccattagcaaatccccatttatctgccgcttcagtaaacgtcatcacttgattcaaatcaatcacatttaccaacctccatttttattattatagaacttttatgtgtggttgtatagactttacaatgcaagaatatccgctaatgctttagcaccattcatcgttccaaatgttctcatatcgatagctgctaccggggtattatactttgcaaatattttttgaattgtcggcaacataaaacgttcttgcggagcaatccatatacttgaaattttttcacctaaattatattccttaatacaacgttcttttaaaaactcagccggtccataagctaaaattatctcatatttattatcatactcatcataattctttaatactgtaaaaatatcttccactgtagttggaaccttagaggcatccccaatctttttacaaaataagcttgatgttgccccaccagcacaacaaatatatactaacattttattttctcctctataaatttgtttatttcttctgcaaaaacatctacttgatcctcaaaaacagcatccccacaatcagcaaataaaagatatcgaattaattcattttttattagttcgatttgctgatcaagattttgataagcacaaatcggattttctttttcctgcatgattaacgtcaaaactattaaattatcaaataggaaaccaaaataataacaataaaaccagtcgctcatcgcagtaatatgttgcaatgaattagaggtattaagcgagctaaagacaaattcttgagttgatgataatgaaaaaaactcttctggtgctaatcttgctgctgtaggaactttatcggtagaacaaactttatttgcataaaaagatttcattaaaaaaagaattctactggctgttgatgattaaaaataatcgccgagctgcttaaaaacaagacccgtaaacgattgataaaaacatactatacataagcaggccaaataacctcaaaacgatccacccaaagaaccagtttttctatatcccattgttttttattacctctacaacagcaaatacatcggtggtaatttgttcaattgttaagccgttacggagatcatattctgacttgccactaccacgttgatcaaaataaaaacattgctaccatttctcaagttcttgaaaaggcgataactgcataagtgcatgtgccccactgccaggactaccatgaaaaaataaaatccctattttactacacaattgtgatttaccataaagagtcaaaatacatccctaattcaagatttgagattcattcataaccgctctttgtcactatatagtgacaagtttatattaacacttagtaactagcattgcaagtaaatttattaacataaaaaacaagcagggattaacctgcttgttccatcatttctatttcatcgtcattatcaattaaatcatccatatcttcttgactcgctaacattgcttcttcagcttcgcgcgctaatctttccggtgatttaagagctccacgaagaccagtccctgctggcaatagcttaccaattaatacgttttctttcaatcctaataaatgatctttcttgcctttgattgaagcatcggtcaagatcttagtagtttcttggaatgatgctgcagataagaatgattcagtttcaagagatgcttttgtaatccctagtaatactggacgagctactgctggatgcttaccatcttttaaaacttgtttatttaattcagtaaaggcgtttacattaatatttgtaccaggtagacaacctgtttccccaccttcaactactttcatttttcttagcatttgtttaacgatgatttcgatatgtttatcagaaatttcgataccttgaattcgatataccttttgaacctctttaataatatagttttcaactgcttcaacatcagcaactgataataattcctttggatcaattgaacctttagtgattttagctccaatattgacatgatcaccaacgttcacccggattttagcaccgtatggcgctaaataactacgcgtttctaaatcattagtaataacgacttccattcttccagcgttatcaataatattagtaacctctccttcgatttcactaataatagattttgcttttggattacgagcttcgaataactcttggatacgaggtaacccttgagtaatatcggcaccaccggcaaccccaccatcatggaatgtacgcattgttaattgggtaccaggttccccaattgattgagccgccataatacctacagcttctcctaattcaaccacatcacctgtagctaagttacgtccgtaacatttacgacatactccacctttagcattacaccctaaaacagaacgaatctctacagcagtgattccagcattaacaatttcatcagctaatgcttcagtaattaattctccaccagcaataattaattctttagtttctggatggaaaatatctttttgtgaataacgaccaaccaaacggtcatgtaatggtacaatgactgatttatcatcattattgtataattctgtaactacaaagccacggtcagttccacagtcttcttcagaaataattacttcttgagcaacatcaactaaacgtcttgttaaatatccagaatcggcagtttttaaagctgtatcggtagaacctttacgagcaccatgggtagagataaagaattctgatgctgttaaaccttccctaaatgaagacttgattggcaactcaattgtttccccttttggatttgacattaatccacgcatacctactaattgggtaaagttagataatgatccacgggctccagaatcagacatgatgaagatcgggttacgatcatcagcttcgaactctaaacgtacaacttcttgaacttcgtctttaacgtcagtccataatttaattacattttgatatctttctgattcagttaatttacctttattatagaactttttaatttgctctagtttttcatcagctttttcaaaaatttcatatttagcttccggcacttggatatcgtatacagatacagttgtaccagcaattgttgagtaatagaaaccttggtcttttaatttatcaagcattaaacttgtatcagacattgctgaatgtttaaacacttcatcaatgatctttcctaaagattttttatttaaaggtttaataatcttttgatttctaatgtgttctttaatatctgttcccattggaacaaaatatttatctggagtagcgattaagttttcactgcttggatcattaataaatgggaatttaccatcaaagatgtcattaaataaaattttcccaacagatgtgattaaataacaatcattttgtgctttagtgaaagtttcattctttaatgctgacgctttgattgctacacgagtgtgtaattctactgttttagcaaaataagcatgatcaacttcattacgatcagcaaagacagttccttctcctaagccaccttcatcttcaagtgttaaataataatttcctaataccatgtcctgagatggtgtaacgattggttttccatcttttggacctaagatattatttgaacctagcattaattgacgagcttcttgaattgcttcttcacctaatggtacatggaccgccatttggtcaccatcgaaatcggcattgaacgctggagtaaccagtggatgtagacgaattgctcgcccttcaactagttttggttcgaatgcctggattcctaatctatgcaatgtaggtgcacggttaagtaacactggatgttgttgaataacttcttcaacaattggccagatccgatcatccattttatcaattaatctttcagcagctttaatatttgttgctaattgatccctaacgagaccattaataacgaatggtttgaatagattcaatgccatttcacgtggaatcccgcattgatacatttttaaatcgggaccaactgcgattacagaacgtcctgagtaatcaacacgtttaccaagtaagttttgacggaaacgaccttgtttaccttttagagtatggcttaatgactttaatgcacgtccaccagcaccagtaatcggttttgaacgacgaccattatcaatcaaagcatcaacagcttcttgcaacattctcttttcgttttgcacgataatagaaggtgttccaagttctaataatttctttaaacgattattacgagtaataacacgacgatataaatcgtttaaatcagaagtagcaaaacgccccccatccaattgtaacattggacgcaaatcaggtggtattaccggtaaagcttcaagaatcatccactctggttcatttgttgaagttctaaaagcctcaattgcttctaatcgttttaataattttgttctcttttgaccttgagcttctttaagttctttagttacttttgcaaattcagcatctagatcaacttgttgtaataatgtttgaattgcttcagccccaatttgggcttcaaaagtatgaccaaattgttcaaaacatttacgatagtctctttcagataatacttgcttgtattctaatggtgtacttcctttatcaataacaacataagaaacaaagtaaataatttcttctaattgttttggtgacatatctaagataagtcccattcttgatggaattcctttcaaataccaaatatgagcgattggtgttgctaattcaatgtgtcccattctttcgcgacgaacagctgatttagttacttcaactccacaacgatcacatactacacctttataacgtacttttttgtatttaccgcaactacattcccagtcctttgaaggaccaaaaatcttttcacaaaataatccgtccttttccggtttttgagaacgatagttaatagtttcaggttttttaacctcaccataagaccattcgcgaatcttttcaggggaagctaagccaatttgaattgctgagaatttatttgtatttgccatctttattcctcctataatgattcactttcttcgatttcttctaattcttcatcaaaatcttcgtcgatatcttcgaaatcttcctcttcttcgatattacgcatatctacttcattatcattttcatctaatagacgaatatctaatgcaagagcttgcaattctttctttaacactctaaatgattcaggtaatcctggttctggtaatggttgtcctttaacaattgcttcataagtcttaacacgaccaacaacatcgtcagattttactgttaatatttcacgtaatgtatatgcagcaccatatgcttcaagtgcccaaacttccatttccccaaatctttgtccaccattttgtgctttaccacctaatggttgttgcgtaactagtgagtatggaccaactgaacgagcatgtaatttatcatcaaccatgtgggctaatttaatcatatacatgattccaactgagatattattatcaaaatattcaccagtacgaccagaaataacaggttgtttaccatctttagacattcctgcttcagccatgatatcttctagatcacttggatgtaaaccatcgaaggctggtgttgcaatatataaacctaattgacgagcagcataacctaaatgtaattcaagtacttgcccgatattcatacgagaaggtacccctaatgggtttaacataatatccaatggtgttccgtcttctaagtgtggcatatcttcaattggtaaaattttagagattacccctttattaccatgacgtcctgccattttatccccttcagaaatttttctcttttgaacaatataaactttaacaactttattaacacctggttgtaattcatcaccattttttctttcaaatactttaatgtcatgaacgattccagccccaccatgaggaactcttaatgaattatctttaacttcacgagatttttctccaaagattgcaagtaataatttttcttctgccgaaagctcagcttgaccttttggtgttactttaccaactagaatgtcaccctctttaacctcagcaccaatcataatgatcccgtcactatttaggtttttacgagcttcatccccaacgttaggaatgtcacgagtaatttcttcgggccctaatttagtatcacgacattcgattgcatactcatcaatatgaacagatgtataaacatcatctttcactaatctttcagacataataaccgcatcttcatagttatatccattccattccatgaatcctactaatacgttttgtcctaaagcaagttcaccttgttccatagccggaccatcagctaaaacttgacctttcaatactttttccccagtcttaacgattggtttgtggttaatacatgtaccgttgtttgaaatcttaaacttagataaacggtagcgatgttcaaccccttcattatcttcaacaattacttttttagcatcaacatatgttacaattccatcttcacgtgatactactgccgcacctgaatcacgagctgcctgatgctccatcccagttccaacaaatggcgtatgtggatttaacaatggtacagcttgacgttgcatgttggcacccattaaagcacgagtagcatcatcattttcaaggaacggaatacaagaagtagcaaccgatacaatttgttttggtgaaatatcgatatagtctacttcttcgcgcttagccatgatattttctcctaagtgacgagcaataacttgggcatctagaatcgtaccatctttatcagttctaacatttgcttgcgcaataatataatttttttcttcatcagcagttaaataacgaacatcatgttcatcaataacacaattatttactttacgatatggcgtttcaataaacccatattgattaattttagcataagaagctaatgttgaaatcaacccgatgtttggaccttcaggtgtttcaattggacaaattcttccgtagtgagacgcatgtacgtcacggacttcataaccagcacgatcacggcttagaccaccaggccctaatgctgataaacgacgtttattagtaagttcggcaaggggattgatttgatccataaattgagacaattgtgaagaagagaaaaattccttaattgccgcagttaacggacgaatattagtaagtgattgtggtgtaattgaatcaacttcagacaatgacattctttcttttacaacccgttccattcttgataaaccaattctaaattgattttgaattaattcaccaacagaacgaacacgacgattacctaaatggtcaatatcatctaataatccaatccgagccattaagttaacacgatcttcagctgttaaatctaacgcatcatagatatctactaagttaaacatatatgaataagcagccatcatatcagaaatagtaacaaacttactatctaaagataaatcagtaccaataactcgcatctttttagttttagtatcatctacataaacatctaatacttggatcacaccgtttgattctaatctagggttggtatcaagttcacgtgtatgagctccagcttcaagaattggtttaattgtatcactaacttcttgagtaactacagtaccctctgggtatactacatttccgtcaacatcaactaaatcttctgctaaaatacgtcccgcaatacgatctaaaaggctcaatttttttctgaacttaaagcgtccagctttagctagatcataacgtttacaatcaaagaaacgcgtatataataagttgttagcaccttctaatgttgctggttcacctggtcttaatttattataaatttcaattaaagcttcttcagtattagttgtattatctttagctaaagtgttgatgatatactcgtgttcaccaaaaacatcgatgatttcatcgttacttgaaagacctaaagctcttaataatacagttcccggcatctttctattacgatcgatacgcacgtttaaaacatccttagcatctgtttcaaattctagccaagtacctcttgaagggataatactcccattaaatactgttttaccacttttatctaaggcatcagcaaaatatgcccctggagaccgaactaattgtgatacgataacacgttcagcaccgttaatgatgaaagttcctgagtcagtcatcaatgggaaatctcccataaatacttcttgttctttaatttcaccagtaccagaattaactaaacgtaaagatgctctaattggtgcagcatagttagcatcacggtctttgctctcttcgactgaatattttgcttcatcaaatgtacaatctacgaattctaacgacaatgtttcgttaaagttagtaattgggtagatatcttcaaatacttccttaatacctacttctttaaaccatttatatgaatttgtttgaatttctactaaatttggaagttctaaagatccactaattcttgaataattacgacgagtaatcttgctttttgcttcagttattttgttttccacgtattaactccacccctttatatttctctatcaacatgttttagagcgcgcaaaagcgcttgattttaaacattaataggcattttaatactctatcacaaggatattttaaagtcaacaaaaaaaataaaaaaatatcaaaaaaactattgacaagtaaatttacttgttaatagcttttaaaatataatatcctttatccttttttacgacatttgcattaccaaaaacactttctagattcttcttagctgatggcgccccttgtttcttttgaatcacaacccaaatttctccatgaagatttaaatgttctttagcttcaactaaaatttttgtaacagtttcttttccagcccgaatcggaggatttgtaacaattacatcatatttattagtaacattttcataaacactacttaaataaacattagcttctaaattattagcagctagattctgttttgctaataacaaggcccgttcattcacatcaatcatatcgatttccaaagccgggtaagcacttttaagagcaaccccaaaagtgccgtaaccgcaccccacatccaataaagtagatttaccctcatctaattcaattgcatctaataaaactcgtgatccaaaatcaatcatttttttagaaaaaactccatgatcactagtaaatattagttctttaccacgataagtaaaaataaattgttctggttcactaattaaatcttcattatttgtatagtaatgtttcatatgtcctccaagataaaagagccccgaagggctctttatttagtcaaatataaattatttaacttctacagaagctccagcagcttctaatttttctttaatttctgctccttctgcagcaggaatgttttctttgattacagatggtgctttgtcaactaaacctttagcatcaactaatcctaatccagtgatttctcttacagctttgattacagcaactttagttccaccagcttctgtcaatgtaacagttacgttagcaggttctccagcagcttcttcagctccagcagcagctacagctacaggtgcagcagcagttacgtcaaatttttcttcaattgcttttactaaatcatttaattctaagattgtagcttcttctaagtaagctaagatatcttcatgtgttaattttgccatgtttattttcctccaatttatatagctgattattcagctgtttcttcttttgtttcttcagctgtttcttcaacaactggtgcttctggtgcagcttcctcaactggtgctgcttcttctgctgctgcgctaccatcttctggtttagcttctgcaacagcttttactacgcgtgcaaacttgctaactggtgcttgtaacattccaagtaacatagagtacataccttcgcggttaggtaatttagaaatttctttaacttcatccactgttaataatttaccttcaaccactgccgctttaattactaaagcttcatgatctttcgcgaattttgcgattactcttgctggtgctacagcatcgctattaccaagtgcaattgcgtttggtcctgttaattctgcattaagtccttcatattctgttgctacagtagctctttgaactaatgagtttttataaacttttaattcaacatcttctgcacgtaagttgttacgtaattctgtcatttctgcgacagataaaccacgatattcaactacaactgcagattgagctcctttcaatttagcagcgatttcttcgactaatgcgctttttgctttaattgcttctgctgacattgtcacacctcctgtaaatttttatatatgcaacaatatactcaaactaaaactctcgtttaaacgagagtcaaagtcaatatataatatatatctctttaacacctcggtaacaaattaaggtttcccagttactgtcttgggtatattgattgcgccttgtttagcagctactatttagcggctgcgattttaatgctaggtcccatagttgatgagacaacgatgtttttcatataaacaccttttgaagtagaaggtttgatttttactaataaatcatagattgctgtaaagttttctactaatttatcattatcaaatgaaacacgtccaattgtcatttgaacatttccttctttatctgtacggtaagttaccttaccagcttttgtttctttaacagctttagcaacatccatagttactgttcctgttttagggttaggcattaatcctttaggtccaagaatacgacctaacttacctaattcagccatcatatcaggagtagcgatcattacttcaaaatctaaccatccttttttgatgtcttctaaaatttctttaccaccaacaacatcagctccagcatctttagcttcttgagctttaggtccttcagtaacaactaaaacttttttagacttaccagtaccgtttggtaatactaatgccccacgtaattgttgatcagcttgacgaggatctactcctaatctaaatgcaacatcaactgcggcatcaaatttaactttactagtttcttttactaatgcaactgcttcttcgattgaataagctttacctttttcaattaatttagcagcttcttgatatcttttacttttctttgccattatttttcctccttagtggtcaaacggattatccttccacaaatgacgattaatatttaatctttaattatgcttctactttaacacccatgttacgagcagtaccagcgatgattttcattgctgattctaaatcgatagcgtttaagtctggcattttgtattcagcgatttcttttaatttttcagctgataatgtagcaacttcagtagttccggcattgcttgaaccttttttgattccacaagcctttttaatcatttccgctgctggtgcagtttttagtacaaaactaaaatctttatcttcataaatagtcaaaactactggtacagtttcacccatacgatctcttgtttgatcattgaaagctgtacagaatttaggcatttgaattcctgctcctgctaatgctggacctggtttagctcctccagctgggaattgaatcttcatgactcttgcgacttttttactcacgtgacatacctcctatataaaatttgtccgtgctgtggtcaaatggacattgtccttccacgcatagtaacacatattgcgtcaactaaggattatacattattattcgataaatgcaatacttttttatttttttctctaaattatttttatttatggtcaaatatcttagatcagctaataataaaacctgctttatttcctttactataagatttatactaaaacatttatcttattcatctaataaaataaatgttttcgggaatattattattgcatattattggacaacattaataaatacgtctaatatatcaaataagttagctataactaaccaaaggagagataatatgaaaacattacaaaataaagtcgctattattactggtggtggtcgtggtattggttttgggttagcaaaagcctttgctaaagccggggctaacctagttattaccgggagaaacagaaatactttacacaatgctaaagagaaattagaatctcaataccaaatcaatgtactatgcattcctgctgatggagctaatgaagatgatgttaataatgtcattaacaaaaccatcaaatattatggaaaaattaatatcgttgtaaataacgcacaggcatctaaatctggcgttatgttaaaagaccatactaaagaagagtttgatttagcaattaattccggtctatacgcaaccttcttttatatgcgagctgcttacccatatttaaaagaaagtcatggtagtgttatcaactttgcctcaggggctggactatttggcaaactcggacaatcttcttatgccgctgccaaagaagggattcgagggttaagccgtgttgcagcagctgaatggggtcctgataacattaatgtaaatgtaatttgccccttagcaatgactgaaggtcttactaaatggaaggaagagtaccctgacttatatgaaaaaactattcaaggtattccaatgcaacgctttgctgatcctgaaaatgacattggaagtgcagcagtcttttttgctagcgaagccggtcactacattaccggagaaactatgacgattcaaggtggtagtggtcttcgaccttagtcgtaattttaaactaaaaagagtgattcacttgatactactcctaaaactggaacccccagactaacagtaaagataatatcagcagaacactctttctttttattatatacggacaaaaataaaaaccccacaatggaggtttctatagttcgatttctgttttccataatccatgaagattgcaatattcatagactgtagctttaccacttttaccagcaatattaaacttagcaattggttcgtcatcagaagttagtgtgaccttcttattgctaccatcagcaaattcaatccaaatattactaattaaatgttctggtgtcattggatgtaaaacatcccctacaacagcagttaagcaatcaccttctacttttaaaactggaacatgtttttcaagtgccgcatcaaccgcacctgcttcaacctcttccattttcttaccacagcacattaatggtactccatgatcctcaaccatttccacaacatttccacaaattggacattttaataatttcatcttcaaacctcctttttaatttatctatcccttgcaactacactatagcatagtttaacaataatagttactaatatgctttattaatttaattaataaaactccttctttattataccctatttaaataaaaatatacatattaaaagagacttctttatgaagtctctcaattattatcctaagttttcaatcattgcaatgtaagaatcagcttgtaaagaagctccacctactaaagcaccatcgatatctggttgttctaataaagtttttaatccttctggtttaactgatccaccatattgaattctaacttgatcagcaacttcttgaccgtaaagttcagcaacaacactacgaatatatccacaaacatcttgtgcaatttcattagtagcagtttttccagttccaattgcccatactggttcataagcaatcacagtacgtcctgcgcatttagggcaaacatctttgaaggcagcaactgtttgagttttaacaacatttttagtagttccagcttcgtactcttctaatgtttcaccaacacaaacgattggagtcatatcattttttaatacttgtaacattttagcattaactgtttcatcagtttcaccaaaatattgtcttctttcagaatgtcctaggattacccattcaactccaatttcttttaacatttcaacactaacttcaccagtataagctccgctatctttgaaatgacagttttcagcagcaactaataattttttagttccttcttttgcagcttgtaaagctaagtatggcgtagcaataccccaatcagcactgtctgatactttagcatctacagcttcaacaaacgcttttgtttcagcgattgttttattcattttccagtttcctacgataattggttttctcattataatttccccttattatttatcatcgattgcagcaataccaggaagaactttaccttccatatattctaatgaagctccaccaccagttgaaatgtgagaaactttatcagcatatcctaattgcataacagcagcagcactgtctccaccaccgataatagtattagcaccatctaagttagctaaagcttcgcatacagcaattgttcctttagcaaatggttccatttcgaacacacccattgggccattccatactacagttttagcaccttgtaatgcttctttgaataattcaacagatttaggtccgatgtctaatcccatgtatccatcaggtacatcttcaccacattctttgatatcaccatctacagcaaatttatcagaacaaattgaatcgattggtaagattaatttatctccggctttagcaattaattctttagcgatttcaattctgtcatcttcaactaaagagttaccaatgttatgacccatagctttagcgaaagtatagcacatacctccaccaacgataactttatcagcaacttttaataagttttcgataactaagattttatcagaaactttagctccacctaaaattgcgaccattggtctttcaggatcatttacagcttttccaatataagcgatttctttttcaactaagaatccagctgcacttggtaagtgagcagggataccagcagttgaagcatgtgctctatgtacagaaccaaatgcatcttcaacaaatacatcacctaaagaagcccaatatttacctaattcaggatcatttttagattcaccagcttcataacgagtattttgtactaagattactgctccatcagcagcatttttgattgcatcttctaataccggtcctcttgttgcattaacaaaagtaacaggttttcctaaatgtttttctaaacaaggagctacaacagctaaatcatttttagctttgtcttcttctgtttttacttttcctaagtgtgagaataaaactacacattttggagcttgttctaatagataattgattgtaggtaaagcagctaccacacgattatcatttgtaatttctccagtttctttgtttcttggtacgttgaagtcaacacggcataaaactacttttccagcgacttcgatatctttgattgtttttttatccatctttaatattcctccatggctgaattatatcactgttattcattgttttcaattaatttcatacaatataatgaggtgaaatatatggaaaacagccaattaatcagtgtcgacaaattacccgaattactaaaacatgattatacatttatcgatttaagagatcctttacaatttaataaaattcatttgcgcaagttcatcaatatcccttacgatacttttatcgccactccaccacaattccccaaagataagcctatttatttaatctgttacagcggcaaaagatcccttgatctagctcaaaaattaacgcgctgtggttatcacgcatacagcttcaacggcggtttttatgctgttgaacaccccatcaataaacaattttattgatgaaatcatgctaatttattatcacaacaatagaagtaaattaccatattcacataaagtacacattttctgtgatataataggtacttaagaagggaatgattaaatgattgaatttaaaaacatctataagtcttttaaggacaaacatgtactagaagacgtttcgttttcaattgataagggagaattcgtttgtatcatcggtcctagtggctgtggtaaaactaccgctttaaaaatgatcaaccgcttgatcaagcctactcgtggggctatctatgttgacggtaaagacatcagcaaagaagacgaaattgatttaagacgaaatattggttatgtaattcaacagacaggattatttccccatatgactgtcaaagaaaacatcgaattaataccaaaattaaaaaacaagaaggatcccagccttgccaccaaggttgttgaactattggatatggtaggactcgatccagaagggtatatgaacttataccctactcaaatgagtggcggtcaacagcaaagggtcggagttgcccgagcgttcgccagtgatccagagatcatcttaatggatgagccatttagtgctcttgatccaatcaccagagaacaactccaagatgagttgctaacgttacaaaacaagctacataaaaccattatttttgtaactcatgatatggctgaagcaatcaaaatggctgatcgaatttgtattatgtctgatggccgtgtccaacaatttgatacgcctgaacaaattttaaagcatcctgctaatgattttgttcataacttcgttggaaaaaaacgaatatgggattcgccagaattaatcaaggtagctgatatcatgattgataagccaattacttgtaatgtcaatttaaaatgtatcaaagctgtaaacattatgtataattataaagttgatagtttgatgatcgttgataatcatcaaaactttttaggaattcttgatgctaatcaagcagctagagaaaagaatcgtgataaaaaggtcgatgaggtaatgcataccgaatgtttatcagttaaacccgatgaatctatcgttgatgtcatcaatctagctaacagcagtaatatttacactttgccagtagttgatgataaaaacaaattagttggattaattactaagagtacattagtaaccactttatcaaagaaatatgatgaaagtgaggatgattaaaatgaatgaatttattaattactttagtcaaaacttttcaactatcttcggactctttatcgatcatattcaactaacgattcttgctattattatttcaattttaattggagttccactaggaatcattattacttattttaaaccatcaaaaaaaccagtcatggcaattgcgaatattattcaagcaattccatcaatggccttgttaggattcatgattcctttattaggaataggaacaaaaccagcgattgtaatggttatcttgtattcgttattaccaattataaaaaataccgtagctggattggatagcattaatagcgatacccttgaagcagctaaaggaatcggattaacaccaatgcaagtgctttataaagttcaaattcctttagcagcacctgttatcatggccggagttagaatctcagcagtcagttcagtcgggttaatgactctagcagcttttattggtgccggaggattagggtatttagtctatgcgggaatccgaacagtaaataatgcacagattctagccggagctattcctgcctgtatcttagcattattgattgattatattttttcaattttagaagtcttagttacccctaaatgcaatcaactagccagtccacaaagcaaaggaaaaaaacttattgataagatcgttattatcgctacttgtatctgtctagctggaagttttgtttatactaatttaggcaaaactagcgataaaatcacaatcaatattggtagtatggacttttctgaacaagaaatattgaactatatgttaaagtatttgattgaaaaaaataccgatgtagaagtaaaccagtcattatcacttggctcttcgtcaatcgtcttagatgcgatgaaaactggtgatgtcgatatgtatgtcgattatacaggaactatttacggtagtgttctcggccttgagcctaacagtgacgtagaagctgtctacaacacagtcaaagacgaaatgaaaaaacaatataattttaccgttttagaaccactaggatttaacaacacttataccttagcaatgagcaagcaaactgctgataaatataacatcgaaacaattagtgatctatgtaaagtttctaatcaattaatcttttcaccaacattaacatttgttgaaagaaaagactgcttagtcggtttacaagaaacatatccacttcagtttaaagaagttatcccaattgacggttcacctcgatatacagcattagttaataatgaatgtgatctagttgatgctttttctactgatggactattaaagaaatttgacttaaaggtgttaactgatgacaaaaacttcttcttaccatacaatgctattccgatcattaatcaaagaatcaaagatgaatgtccagaaatcattgaattagttaatcaattacaaaattatctaaacgaagaagtaatggtagacctaaattataaagtagatgaagaaaaacaaaaaacaaaagatgttgcttataactttttattagaaaacaatttaataaaataatcgagtaggagaaaataaataattttatatttattttcgacctctcacaccaccgtacgtgccgtacgacggtttaaatctatattgaaatatgttttaactgatactggactaccattgatggtagcccttttttatatagtaaattgtttgttatttttgtttgtagaaatgtgcttgcacatcttgcatatgactcacgacagtttgcctaagtctttgcttgccatggtaatactcctaattttattagttgcttttccctgcttttgttcgtcttccacttcttccaaaggcacattcttattcgaaattttatttgtttatctagttttctacatacacccataaaattttctatccgatagtaattaatccatccaactatcagttgtcttatcttaagtattctatattcccaagatactgaccaacttctatttgttagtttcttcaattttgtttgcagttttctcatgtggttttgctttccacatagatgaaaaagagtcatagtagaaaccaaatcctagatatttaatatcattaggtttcaaaattttgcttttagtcatgtttaccttaaatctacgtttcttttctatgaatttactaatgttttccattactctatcggcggctttactgctacccactaatataatacaatcgtctgcataacgtgtgaatcttagccctcgtgcttccatttctttatctagttcattgagaactatgttactgagtaggggacttagatttcccccttgtggtgttcctacgactgactctctatattcattatcaatcataattccactcactaggaattttctaattagagatactatctcctcactttttacacccttcatgacaagtgagatgagtttatcgtgattaactgtatcaaagaacttttccaagtctatatctactacctactgaaagccttaattcatatattctaacgctttgataattgccatttcgcaacacctatttggtctaaagccaaaactattgtcactaaatattgattcgtagataggtattaatacttgggctatggcttgttgaacaaatctatcaagtactgttggtactcctaaattttgtactccgccatcaggtttaggtatttctactcttcgtacaagttctggcttatatgtcttgttacgtatactgtccttaatttcttctagataacctttaagttcatctactcccatctgctccacttgcacttttgtttcgttttacttgtgtaaatgctagtcctagattagtatcactaagcacctgttcaagcaatgcattatcagttttcatatttccgttacctccatttctttcgctatccattatactcacttcccctgtattcttctttcgggccttcgctccatgaccattacagccacttctttgctactacgacctctgctgacttcccatgattcattattactaggatttctccatcatgagacctcccaggataaggtcatatctctttccttccatatatctgccacatttacatataatagtttcattccacaacctcttatgacttcatgttgctttgcacactcgtccccattatatgcctgatgtgattcatgttcctcggaccaagattttgcctccatcttctttcagattccacctcacgatagacacccttgatattggctagtggttggcagttgcgacatcacccccacagtggactttcaccacctagatatatgccatgcccggcatacaaaaaaggattgagatacgcaatttatctcaatccttttcttattaatatctgtcgtatttctttaatgcctcaggttcttgttcttggtgaatatgtctagaagaatatacacttaccgcttgaacagcaactaaaaataaacctgaacttaaaacttttaatactttactttttagatttttcataatcaatcttccctcccaacattagtagattaatcacaataaatatataaaccattatgtctaaatatccattatgaatatggaataatgccgctattattgttagataaattattaagactatttttgaataacgtttgaatacatctttcttctttttactcgcaactttattcacgttatctactggacctaaagctaaaatattaattgaaccaatcaaacacactattaatattgtcattaatgtaaaatgataataatttaaaaatataacacccgccaagaaaaaaccagcatatgtacaaatacaagcggcataacttttacaatgatatccgcctaaaattgatcttgtgcttgataaaacaatttcataaacaactgcttcaataaaatgattagtcattaaacccaacactaaaagcagcaacgtcccaatcacttcagaaataatcagcttagctccatgaaggtatatttccttatcctcatctaaataattacctttgtctaaataattcactaacttatttgataaactatcaatcataaccacatctccttgcatcacaatatcataacaccaaattaatacaatatatatgtcgtaaagtactattttatttcgcgaatcgtcaagtttcgtatataatagtcactaaaggagaaataactatgtataagtttgcaattattgatgataatcattttgaccaaaaattaatcctatcgacattagaaaaggaatgtcagcttcataatattgaatataaacttgatgtttataataattcattgaattttgatttgagtattttttatgacgctatcttcttagatatcgaaatgcctaaagaagatggtttttcatttgccgaacgtcttaacaattattatgaaacaaaaatcatagttgttactaataataatgattatcgcgcaaacgcatacaatattcatccatttcagtttattaataaacaaaatattaaaatagaaataatcaatgtctgtaatcagttatttaaatcattgaaaaagaatgataaatttattactggttatatttacgatcggaagaaaaatattcgcatcaaagatatttattacatcattgtagaagatcacttatgttatatctttttatatgaaaacaaaaaatctatttgtattcgtgacactataggaaacattgaaaaatcccacctttctaatggattagtacgcattaatcgttctactataataaatatgttacatataaaagatattaaaaagaataaaatttgtttaaaaaataatatcgaactaatcatatccttaggatataataaacatttcgaaaaacactatcaaagctatatttgggggttactatgagctattttgatttaattatcaatatgacagaatcgataatttcgattttattcatatatataatttttaacactagaaaaagattactttcatattttatttttgtagggataaactttctttctataagcctatgcaattatttttctgtacctgaaataactctaattctcttatctattgttattttattcacctattcaaattatttaaatcatcacaaacatctgcaaaatatatttattgcattatttataaatacacttcttaatgtagcaactactttatcaatttgtttctctactttactagccaaatttccaatcgattcagttgacggttatcatttaatggctatgatttcaaaaccaatcttacttgttctcgtacttgcaacagccagtcatattaaaaagtattattttttagaaagtcaagtacttaaatatattacaatttcaattgttttattaaactttatttacagcgttactgttgattacatattttatggggataatcttaattccactctaacattgctattattgcttattgatgccctaacaatctgtctttgttttgtattctttgaggcccagcgcgaacaatatcgtattctcgaattacaacgaaaaagtatgaaaattgaaaacttagaaactattcaaagtatcaatgaaaataattatcaacaactaagaaattggaaacatgatattatccatgtctttaatgccataaaatatcaactaactaataaaaattataatgaagcttttaaaatcatcaatgaatataatcataatttaaatagcaataactttgttcaatcttctggaaatgaattattagattatttattattacaaaaagttaatcaaataaaggataaagagattcatcttataactagttgtcataataccattggtccactggaagatgcctatttctttattattgtgggaaacttaattgacaacgcaattgaaaattgcgattcaaatttcaataaacaactttgggtttctatcgggacaaaaccagagtattattttattagtattaaaaacagtatcaaagatagtgttctagctgctaatccagatttaaatacaactaaagttgactctgaacatcatggaattggtattaataacgtacggctattagtcaaccattaccaaggtttaattaaattcgaagaagatgaaggttactttattgtcaaaatactaataccaaataatcccgccagttaaactaacgggattatttttataatggtgcattgtaaaaacgaccaacatatttttctgacttacttacattaataattatcttggggtcaacttcttttaaagcagtaacaacatcatcaacctcataacttgaaacaattgccgttaacatagaaaccggcgtcttagaatatccacccattccatctaaagctgtaatcccatgatgaaaatttttgcaatatattgccataacatcatctttgttttttgtgaaaatctgcatcattacacgtttataacgggtatgaaaattagaaactgtttttgttgacataaattggaataaaattgaatatcctgctgcctcaaaaccaaaaatatatccaaatacacacaacattattgtattaaaaatgaacacttgattccagatttcctttccgctcttattggaaacatacaatgctataaaatcggttccaccacttgaagcattacctttcaaagcaattacaatacttccgccaaacataaatccaccaaaaataacatttaatatcttgtcatcaaataatggaacttgtggcatcaatggtaaaaacaacgatgtcagaccaacctgcaaaagcgaaaagaaaacaaatcgtggtgatattttttttgcacaaaataaagctactgggatatttaaacacaataagccaattgaagtaggtatattgtgcccgattagttcagcaatcatatcgatcattattgcgattcccataaatccgcctgataaaatcccggctggccgaactaaattttttgttgcaaaagccatgattaacgatgataaaaacacagcaccaaagctaatcaagcatttcttcttttttatatccatgttactgatccccttttatacgccccgattatagcacagtgattgtatcaattaaagaacaattataatttatttttgataaaaaaagagcgctccactacgctcttataattagattaatttatattcttttaattgattttcaatatcatgttcatcgatcgtacagcgacattcaccaagctcaattgccggcttagttttaccatgataatcactaccacatgtaatcaaaatctgatgtttttttcctgcttgatagaaatattcaactgtttcaggactatgataattactaaaagcttcaaccccttctacacctaattccaccatctcatcaaaaatctcaaatttaccttttaaattattcccaggatgagctaaaacaactgttcctccatgcctcttgattaaatcaatcgtttcttttaaagtcggataaactatttctgtataacatggtttcccttgagcatagaaatcccaataaaaattaacatatggattatcgctacgttctcccccgctacgatatggttttaataaagaattttcattataacgttgatcatttaataatacttcaccaaacatttcccccgtataaacaccattatcacttaaagcatctaacgctgcttgatcaacatcaaaacctaacatatttgttaattttaccttttcttttgaacatgctagttcttggttcaatacattttcttctaacgtcacgaaatccgcatgatgataatcaaccccataacctaaaacatgtaggttgattcccttataagtacagtcaatttcgacactaggaatatatttaatatttaatttagctgctgcttctttcgcttcatcaatcgctttaacactattatgatcagcaattgccataaccttaattcctgctttgtggcattgttcaactaattgagtcggagtaaattcaccatcatcactatattttgaatgcatgtgtaaatcaatatacttttccatttatctatctctctttcgcattttattttttaatacttcaattcccaaactatacaatccatctttaattaattgatctaaattatcgatatcaataattttaggccaatgttctgcgggtaaataattaattaattgactcgaatcaaactctttaaatacatcactgcaaacaccaataatttccggattgataacacaacaaatcgttgctaattgttttaatagtaaatcatttggagctttaaacaacatttcatcttgctcatgatggctcataaacggcaaatatgatagttcacccgcaaagttagaatatccgctgcataatcgatgattaattaaaataccacatccaacatatttaatcttaggctgatacattaacgctaaattgttagcatttggataatgaattccaaaccctatgctagccgcattaacatcattgtccattattatatcaagattgaaatgctctttcagcagctttaacaactcacaatttcgtaacgcttcaaaatcacaaattccaacttttccatctttacacactcccgggatacttagtgctagcactgttactttataatcatcacaaattaaattacttatggcttctagtaattcatcgattgaaccctcttcactaataagcttttcttcctttaaaatattccctaataaatctgtaattttaacaagaaaataataatattgatcatctctttttaaacttacgttacctaaatgataataatctttatttagaatatattgttttgatttgcgaccaccagttgactgcgcttctccaacaagcttaatttcatcatcttttagtaataattgtaagatgttcgttgttgctgcaagtgatagaccagtatgtttagctaaatcgtttttagtccaaatttcaccattataaaaacacaatcgtacttgatgaatattattcgtttttaattctgtaattttaaccaaatatctccccccccttttttgcctttcatcacaataaaacgaaagattatatacttattataacaagattattattaatgtaaatgttttattcataaaaatttgttacaataatcatcgaggtgaactatatgtctgattctttaatcactaaacgggctttggctaaaactttaaaagaactttgtcagtatcgaaactttgaaaaaatttccattaacgatctaactaataaatgtggtctaaatcgtcaaactttttattatcacttccaagataaatatgatttattacagtggttatattatgatgaattatttgcagatatcgagaatatcattacttttgacaactgggatcaatgtctattaacagttttagaaaaaatatatcaagaaaaagatttttatattagcactatcaataccaatgaacaatatttttatcatgatctatataatctggctcagaaatgtttttatgatgcgattactaagcttgatgtaaacaaaaccgtttccccacaagaaaagaatttttttagtgaattttatgcttatggaattgccggaacagtactccgctggataaaaaccaatatgaaaaatgagcctgcaaaacttgcacacggactaaaaaaaatcgctactcaaagtgaaacttttgctgctagtttattaaataattagacaattaattatatctgtctagtatttagacaaagttaaatctttgtttaaatactttttattttttctggctatactagtatttgttagaagaaagaaggatattaaaaatgaaaactaaaacaaaattattaactggagcagctcttctagctggagctggagcagttgcagcaaagaaatacgctgataacaaagatacagttagaaaacctgttgaaattacaaaccaacaattttatttaattggtggcgggcttgccagtatggccgcggctgcctatttgattcaagacggtcatgttgatggtaaaaatattcatatttttgaaggcatgaaaattcttggtggtagtaatgatggtgccggatcaattaaagatggatttgtttgtcgtggcggacgaatgttaaatgaagaaacttatgagaatttttgggaattattcgatcgaattccttcacttgaccatcctggtcaaagcgtaactaaagaaatactagattttgatcatttacatccaactgaagctcgggcacgtttaattgatcgccatggaaaaattcttgatgttaagtcaatgggctttgataataatgatcgcttaactttaggaaaattaatgattacccctgaatctaaacttgatgatattacgattgaacaatggtttaaagatgcacctcatttctttacaactaacttctggtatatgtggcaaacaacttttgcctttcaaaaatggtcaagtgtttttgaattaaaacgctatatgaaccgcatgatttttgaattcccacgtatcgaaacattagccggcgtaacaagaacaccatataatcaatttgagtcagttattttaccaatcaagaaatacttagatagtcatcatgtcaactttgtaacaaacgctactgttacagatattgattttaaagatgatgatactattactgttaaagtgctttacttaaataaagatggcaaagatgaaaaaatcattctcaataataatgacatttgtattatgactaatgcatgtatgactgacagtgctaccttaggagattacaaaactcctgctcctaaacctgttgaaaaaccaatttctggcgaactctggtataaggttgcccaaaagaaaccaaacctcggtaatcctgagccattctttggtaacattaaagaaacaaactgggagagtattactgtgacatttaaaggaaataaattcctttaaataattgaggaattctcaactaacatccctggtagtggtgctttaatgacctttaaagactcatcatggctaatgtcgatggtcgttgcagcccaaccgcatttcaaagcacaagatgctaacactacaattttttgggcttacggcttatacactgatcgtttaggcgactatattaaaaaaccaatgaaagattgtactggagaagaaatttttgatgaattactatatcatcttcatttaattgatcgtaaagaggaaattaaaaaagacatcatcaatgtcattccatgtatgatgccatatgtagatgcccagttccaacctcgaaaaatgagcgatcgacctcatgttgttcccaaaggatctactaactttgcgatgatttctcaatttgtagaaatccctgaggatatggtctttaccgaagaatattctgtaagagccgcaagaattgcagtttatacattactaggaatcaataaaccaatctgtaaggtcacaccatataataaagatcctaaagtcttgaaaaaagctttagaaaccgcttatcgctagcggtttctttttttatttttgtttctttttgcgataaatcaatactcctgcgataacaacgatagcaattaccataattactatgtatggtgtaatatttgtattatcacccgttaacactacattcatttatattcccccttttcctcattacgctttaacatagcgatctttttttcgcatttcttcaacttgaaattgttttttaattttctcaaggttaattgcaaaatatttttcaatcgcccaacgatcatccattgaaataatctccaataaattcatcggatcatatacatagatatgtaattctgcaaatttctttatcaatgatacaacccctcgaaaacttctaaattctaaagtaaataatgaaccatcatgaaaataaatatttaaatcaatttgataaattgtcgcacgattaatagtgattcgtgttgctgcacctgtggataaagtcatctttactttttcaatctcattaaaataaacgctcctatctttagcatttagatgattaaccggcattaatacaaaacgctcattctccacaatcaccttgaataatccaagaatactactaccgttttttgttaacctgtcaatttgctgatcatcataatcatagacacatttgtatacgttttgcattgtcttgcctccttataaccttatcctatatttcaattattacacttgatatttagattttcaatgcatattataataaatacttttaaaaaacaaaaagatagtaattaaaaattactacctattgtttattctttaaatcagtatcgtcaaaagcttccgcaattgcaccacctggagcaaccatcgggaatactttatcatctttaccaatcatacattcaatcactacaggaccgtcatgctccattgcaattttgattgctgaagcaacttcttctttagttgtaactttaattgctttacaacctaaaccttcagcaactttacaaaaatcaactttatcttcgagaattgtgttggaataacgttgtccatagaacaatgtttgccattgacgaaccattcctaaaacttgattattcataacgacttgaattactggaatattataacggcttagagttgctaattcatttaaattcattctaaaacatccgtctccagcaatattaaagacagtttggtggggattagctaattttgctcccattgctgctcctaaaccaaatcccatggttccagcaccacctgaagaaataaattgacgagggcgacgataattaaagtattgagccgcccacatttgatgttgtccaacatcagtacaaattattgcttcactattagtgagataatcaatttgttcaattacataaggacctgttaaaccttcatcatcataacttaaaggataacgttcttttaaatcacgaatttcttttaaccattgaggatgattttgacgtgttaatttttcattaagttctttaagtacatttttagcatcaccaacgatccctaaatcaacaacaacatttttattaatttcagcagcatcaacatcaatatggataatctttgcatctttagcaaaacgatttgtatctccagtaactcgatcagagaaccgggcccctacaacaatcaataaatcacattgactaaccccaaaatttgaggcttttgttccatgcatccctaacattccagtataacgaggacgggtattatcatatgcgcctttacccattaaagaatccgtaacaggagcatcaattttttctgcaaattctttcaattcgctggccgcatcactagcgattgccccaccaccaacaaaaataaatggtttttcacttgcttcaatcatcttgatagcttgatctaattcttgagcaccataagtatatttacgtggttcgatcacttctggaacaattggctcaaaatcaaatttagccgctgtaacatccttagttatatccactaataccggcccaggacgaccttcgctcgcaatatgaaaggctttacggatcgttggtgccaaatctttaatatctttaacaataaaattatgtttagtaattggcatagtaactccagcgatatcaatttcttggaagctgtcacgcccaagcagcgatactgcaacattagcagtaattgcaactaatggtgttgaatccatgtaagccgtagcaatccctgtaaccagattcgtagctcccggcccagaagtcgccatacacactccaacctttcctgttgagcgcgcatagccgtcagcagcatgggccgcaccttgttcgtgagatgttaagatatgatgaatcttatcttgatattggtataaagcatcataaatatttagaattgttccacctggataaccaaacactgtatcaacaccttgttcaattaaacattcagcaacaatttgggaacctgttaataacatttaaatacctccctctacttatttttttgtacttctaaaatagcaccacgatcacctgaagttaccattgccgcatatctcgctaggtaaccagtcgttacttttggttctcttggctgccatttagctttacgttttgccatttcttcatcagaaatttttaaattgattttatattcaggaatattaatttctataatatcgccttcttcaactaaagcaatcggtccacctactgccgcttcaggtgaaacatgtccaatcgaagctccacgagatgcccctgagaatcgaccatcagtaattaaggctactgttgatcctaagcccattccggcaattgcagaggttggattcaacatttcgcgcattccaggcccacccttaggtccttcgtaacgaatcacaacaacgtctcccgctacgatcttaccacctttaattgcttcaatcgcatcttcttcacaatcaaagacccttgcaggaccactatgttccatcatttccggcacaactgctgagcgttttactacactaccatcaggcgctaaatttcccgataaaacagctaatccgcctgttttactatatggattttcaattgttcgaattacttcaggatcaaagttaactgcatctttaatattttcacctactgttttaccagtaacagtcatacaatcaagattcaataaatttaatttactgatttctttcattactgcataaataccgcctgcttcgttcaagtcttccatataagtaggtccagctggcgccaaatggcaaagattaggtgttttttcacttatttcattagcaaactttatattgaaatcaaaaccaatttcatgagcaatagctggcaaatgtaacattgaattagttgaacatcccaacgccatatccatcgttaaagcattcatcattgattctttagtgataatatcacgaggacgaatgtctttctttaacaattccataatttgcattcccgcatgtttagctaatttaattctttcagaatagacagcaggaatagtcccattcccacgaagccccattcctaacacttcagtcagacagttcattgaattagccgtatacatcccagaacatgaaccacatgttggacaagcatgattttcataataacgaacttcttcctcatcaattttacctgcactatagcttcctaccgcttcaaacattgatgataaactagtttttttaccatgtacgcgtccagctaacattggtcccccagaaacaaagatagttggtatattgatccttgcagctgccatcaataatcctggtacatttttatcgcagttgggtaccataactaaagcatcaaattgatgagctaaagccattgcttcagtactatcagcaattaaatctctagttactaacgaatacttcattccaatatgtcccatagcaattccatcacataccgcaatagccgggaattctctaggtactccacccgctagggctactcccatttttactgcttcaacgattttatcaagattcatatgtccagggacaatttcattatatgaactaacaattccaattaacggtttatccatctcttcttcagttaaacctaaagcattaaataatgatcgatgtggtgcctgctgcatccctttttttacattatcacttttcattttctatcccccttataaatttgcaacaattaagtcacccatttctttagttcctactaaagttttattatctgacatgatatcacttgttcgatatccttgttgtaatactttttcaattgcattttcaatcactttcgcttcatcatctagatcaaacgaataacgaagcatcattgcagctgataaaatagtagcaattggattagcaatatttttaccagcaatatcaggcgcactaccatgacttggttcgtacattccaaatttatcaacacgtagtgatgcacttgccagcatcccaatcgaacctgttaccatactagcttcatcacttagaatatccccaaacatattctccgtcaaaataacatcaaattgttttggatcctttaccagttgcattgcacagttatcaactaacatatgctccagcacaacttcaggataatcttttgcaacttcacttacaactttacgccataatcttgaagtatcaataacattagctttatcaacactcgtgacttttttattacgtttcatagcaatatcaaacgctcttttagcaattcttctaatttcagtctcactataactcattgcatctcgagccactaattcaccattttcttctttcgttgaacgttcaccaaaatataacccaccggtaagttcacgcatgatcatcatgtcaaacccaccctcagttaatccttccttcaaaggacaagcaccctttaattcatcatataagaccgccggtcttaaattagcaaacaatcctaactctttacgaattttcaataaccccgcttcaggacgaagattaggttctaatttataccaaggtgatgttgtggtatcaccaccaattgacccaagtaaaacactatcactatttttagcaatcgccaacgcctcaccagttagaggaacgccatgaacatcgattgaagcaccacccattaaaatttgagtataattaaatttatgattatatttatcagcgatagcatctaaaactttcatcgcttcagttacaatttctggtccgattccatcaccttttattacagcaatatttttttccattatccttacccctttttactattaacatagttgactaaaccatctaattcaatcatcttttgtaagaactctgggaaaggttgactttgataagtttcaccttttgtaatattagtaattaaaccagtggtaaaatctactgtaacttcatcaccttgattaattcctgctactgcttctggacattccatgattggaaatccaatattaattgaattacgatagaaaatacgagcaaaactttctgcaatgacgcatttagttcctgctttttttaaacatagaggagcatgttctcttgaagaaccgcaaccaaaattttttccagcaacaataatatcacccgattcaaccgttttagcaaaatcaggatcaatatccaccatcgcatgactagctaattctttagcatcaaatgaatttaaataacgtgctggaataattacatccgtatcaacattatcaccatatttatatattttcattattcttcacctactttttcaggatttgcaatatatcccgcaattgcacttgcggctgctacttctggagaagctaagtaaattaacgcttctgtgtcgcccattcgaccaacaaaattgcggttagttgtagaaacacacttttcacctttagccataactcccatatgtccacccatacaaggtccacagcttggggtattaaatgcacatccagcttcaacaaaaatttctgctaaaccttcatgaatacattgaacaaagattttctgagtcgctggaacaaccattacacgaacatttttagctacttgttttcccttaaggattgctgccgctttacgtaaatcagacaaacgcccattcgtacatgaaccaattacgacttgatcgatcataatcttatccattgcttcaatttcatcaatcgtatgcccattccctggtaaatgtgggaaagctactgttggtctaactttacctaaatctatttcaatcacttcatcatattcagcatcctcatcagcttcatagacagcatattctttcactgagtgtttttccatataagcaatcgtttgctcatcaacaggaaaaatcccgtttttagccccagcttcaattgccatattacaaatcgtaaaacgatcatccattgttaagtgttgaattccttcaccaacaaattccatacttttataacgggccccatcaactccaatacgagtaataatatccaaaataatatctttaccactaacaaattgactaggctttccggttaagacaaatttgattgcactaggcactttaaaccataattcaccagttgccattcctgttgcaatatcagtagttccaacaccagttgaaaaagctcctaaagcgccataagtacatgtatgtgaatcagccccaatgatacattcaccagcgacaacaattcctttttctggtaaaattgcatgttcaaccccacatttaccttgttccatatgatgagttaaacattgatcatttgaaaaatctaaaattgctttagagttttcagccgacttaatatctttatttggtgtaaaatgatcaggaactaaaatcaccttatctctatcaaagactttgtcagccatttgatgaaaaattggtaatgccatcggtcctgtgatgtcgttagccattacaacatcaagttttgcttcgattagctgccccgccacaactgcgtctaatcctgcatgttttgctaatattttttgtgtcattgtcattgccacttttatattcccccttatctttacctttgtaggttgtaattagggagtaagaaattactccttaattacaacacacaaaagtgtgttgttataataaattagttattgattaatttatcttcatcagaccaagcgtataattttcttacatcttccccagttttttcagaaatatgttcgcttgctaattttctcattgctttgaaatgagcttgtccaccagcttcagacatatctaataagaagtctttagcaaatgtaccatcttgaatatcttgtaatacctttttcattgcttttttagtatcttctgtgataatttttggtcctgtaatataatcaccatattcagcagtatttgaaattgaatatctcattcctgcaaaacctgattggtaaattaaatcaacgattaatttcatttcatggatacattcgaaataagcatttcttggatcatacccagcttcaactaatgtttcaaaaccagcttgcattaaagcacaaactccaccacataatactgcttgttcaccaaataaatcagtttctgtttctgttctaaaatcagtttcaagaactccagctcttgctccaccgatagctaaagcatatgctaaagcaacatcttgagcacgaccagtagcatcttgttcaacagcgactaagcaaggtacacctttaccaacttggtactcactacgtactgtatgtccaggtccttttggtgcaaccatagttacatcaacattcttaggtggtacgatttgtccaaaatgaatattgaaaccatgagcaaacattaacatatttccttcttctaagtttggttcaattgattctttgtataatttagcttgtaattcatcattgatcaaaatcatgatgatgtcagcttttttagctgcttcagcagaagtataaacttcaaaaccttgttcttcagcttttttccaagatttagaaccttcatataaaccgataattacgtttactcctgattctttcatatttaatgcatgagcatgtccttgagaaccatacccgatcacggcaacagttttaccgtctaataaagataaatcacaatctgattcataaaaaattttagccattttttctaatccccctatttctatttgttatgactttctatatcaatttcgccaagaccacgtttgataccagataatccggttctaaccatctcaacaacattgaaaccttctaacatggcaagcagtccatcaatctttgactgatctcctgttacctcgattactaatgatgctggtgcaacatcaataatccgtgctctaaagatatcggcaatggaaacaagtgatgaacgttgtttttcatcagcctcaactttaactaaaactaattcccggtataccgattcttccggtttcaatgggaaaatttcaattacttcgactagtttacctaactgtttttcaatttgatttaaaatcaattcatcaccaacagccacaaccgtcatgcgtgaaacattaggttcattggtcttgccaacgcttaaactttcaattccataaccacgacgactaaataaaccagccactctgcttaatacacctgggttattttccactaataacgataatactaaacgattcatgttcggctcctttccacttattttagcgtcttatacagacgattcattccagatattatcgcttttacagttgcagttgtaatatttggatgaatccccactccgtattcttgtctagcacttcccttagctcttaaataaacataagccgctgcttttgagcttgatcctgaagttaatgcatgttcactataatctaataagtgtgaatgcatttctggaagtgagtttaaagcatttttaacagcatcgattggtccattaccatatcctgttaaagttgtaacttcaccatgcgcctcaatcgtaatctcagcacgacgttcaaactcactatcatcttcacttatatcaatcagcttttgtttaataaagcgataaggttcatcaatatctacatattcttcaatgaatgtatcgtagactctttctggagaaacttctccttcttcttcacttatatcttgaattactttagcaaaatctacttgtaatccttttggtaaatggaaaccatacatactttccattacatatgctacaccacctttaccagattgtgaattaatacgcacaatcggttcatattggcggcctagatcactaggatcaatcggcaaataaggtacttcccaaatttgactgtcacgttcatgcattgcatgagttcctttattaattgcatcttggtgactacctgaaaatgcggtaaacactaactttcctacatatggttgacgaggtgggatttccattttcgttactttttcataaacatgttttatattattgatattgctcatatctagttttggatcaattccttgggtaaacatatttaaggctactacgacaatatcaagatttcctgttctttcaccattaccaaatagtgttccttcaacacgatcagctcctgccataattcctaattcagtagccgctacaccacaaccacgatcattgtgagtatgcaacgatacaatgacacgatcacgatcactaaagtgagtacacatccattcaatttgatcagcatacacattaggtgttgccatttctactgttgacggtaaattgataattactttattgtctttagtagcgccccattcatccatcaccgcttcacaaacttctaaggcatattccagttcagttccagtaaaactttctggtgaatattcaagaattacttccccatcaaattctctacttaattctttgactaatttaacaccatcgactgcaatctgtttaatttcttctttacttcgattaaagacgacatcacgttgtaatactgaagttgaattataaacatgaacgattgctctctttaatccttttaatgattcaaaagtctttctaattaaatgttcacgtgcttgagttagaacttgaacagtcacatcatcaggaattaaattttcatcaatcaaaattcttaaaaaatcatattcaatttgactagaagaaggaaaaccaacttctatttctttaaaccccatatcaactaaaagttgaaacatttcgactttttcttcgattttcataggggtaatcaacgcctgattaccatcacgtaaatctacagagacccaagttggcgctttttcaatttgtttatccggccaagtacgttctttaaagttgattggttcaaatctcttatacttttgataattcatcattttttcttcctcccttttgcataataaatacttataaaaaaactctcgcactcaaaatgacagactatgtcattttgaggacgagagtatagtaaccccgtggttccacctcaatttattaatacctcacgatattaatctcaccaagtacgctattatatatagttcatacttttgctagataacggttgcactccgtagccacctacttgattcagcgctccactcaaggatgagttcaacaaatcatcaacaattcttttcaccacccagaatctctctatgctcgataaatttatttactagttcctatcaaagtatttaagttatgttactgaatataatagcccgtaattttgtcgaagtcaaccctttttcataaattttatagataattaattatctgattaataattaattatttcacaagtcgattcaatataaaagtcctgattttatcaagtattttaccaatatcatctatttattctaatgacaatttagtttcaaattattgaacttatttagacgtaaaaccgttctagaagcaaagagcctatctactatataatcattagccaaacaacgattatacttctttgttaaagtcaaataatcttgcttattaaacataaatatcttaataacttcattatctggatataataaaacaaactctagtccttgtccatctcttaataccaattgataagacgctttgctccttaaagtagtttgaatattatgtttcattatctcaacaattcgatcatctaaaccattttctttaataacgattttttcttttaattcacttacactttttacaaaacgaagttgataagcggttaaatctattttcactttctttaaaaaacggtgtccatcatggctcaacaccaccgcatattttaatttctcatcataatacacacattcatacgaaatcctttgataatgtccacaatgcggacaacgatataaaaacaaatcttcttcaaaaatattctgttttgcctctaaatcttgtctattaattattggatataactgtttttccccaacccctaagcaatgaacacaggtaacttccagcttaatctcattagtcatctttcattcctcctcaatgtccttgcatacattctactaaactaaataaatctaactaccaaatcttctataatttatcttaagaatatgcaaagatttttcagcttatttaagacaattagcatgattgatcatgttacaatataaagggtgataaaaatgtcaaagaaaaaattaaaactaaaacgtccaattaaaatatttcttaattttctcctgcttttatccctcgtaacggggacgtatttatttatcaatagaaaagaaacatcaatcaaatcaccaaacaaatccacttctactaaaaggccaagaatagttaatgcatcttttatcggcgatttattatatgaacagccatactatgattggattggaacaagttacaatgataaaggctattatgacttagtaaaaccatattttttaaatgacgatctaacattagccaatatggaagtccctatcggcggcaaagaattaggagtatccggaactggttatagttttaatgctcctgaggaaattgggaatcaagttatcgctatgggtgtcgatgctgttaatcttgctaataatcatgctaacgacgcgggtcctcaaggacgtatcaatacattaagcttctttaaaaaacaccagattctaacaaccggaatctatgaatcaaaagaagtccgaacacaaatccctacaaaaaccataaatgatataaccttcagttttcttggctacacttataaaactaataagcctgataatcaaaacagagaactgattggttattatcgcaaccttgacactatgaaactcgataatgctcataaagaaatcataaaacaagaagttgcacaagcaaaacagcttagtgatatagttatcgttagtgttcattggggcaatgagtttacatatgctgtcaatagtgaacaaaaagaattagctaattatctaaacgaattaggggttgatgtcattatcggtcatcattcacattgtattcagccaattgaatggttagaaactaccaaccataaaacacttgttgtatattcattaggatcatttatttcagctgataatcaggtaactagagcaacaccagaatttgccaatgcatataatgtttcaatgatcctgcaaataacttttgaaaagaataataattctaccataattaaaaatattaattctctcccagtcatcaactattatgatcaaaaatttgaaaattttaaattggtgcctatagataaatataatgaaaaattagaaaaaagtcataatcgttattcaaaaggattaactaaagacttcattaccaatagttttaacaatgtgattgatcaacagtttaaacaataaaaagcactaaatcagcttgtactaatttaggcttttttaatcttcttttcttatctgcttgatcttgaaacttgctacaattagcattatcataaaaattattaactgaacagccacattaagccacaaaaaatcatttgtacacattaattcaaatccccatgtggccggtaaaattctgcctatcacctgtaatacgttagggagcattgctacagggaacattattcctgataacatgatcgacggtaaaaaaaccagttgcgttgccattcccattttcgccgcacttttgaaaaatacaccaaaaaccatcccaatactcaaactaactatgataaataaaatcacccccaataaatatataaaaatattttcaggtatttgtgctttaaaaataatcggggcacttattaaaattatcaaactcatcacaaataaatgcataatcccagaaataaaattacttgcggcaatcgtccataaaggaatctttcctacctgataagccttttttatgtcactatgataaaattccactaacggatatggagaacctaagactccacccatggtaatagcaaaaacactcattacttgaattatcgttttatcagcatcgggcaaaatcgatataaacccccccaataaacaaataaaagactaagggaaccacataataatgaactaataattctttactgcgaagatttaatttccagtttaatccaatttgatagatgaaagccatcatgattgcacctcttttaaaaatctttcttccagctttggctgaacagtatttatttccataattttaatactttgttcctcggttaattgaataattgcttttaatgttatctctaagtttgtagtctcaaagatataatactcctgttcctgagaaactatttcaaactgctcatttaatcggggcacctttgaaaaacgaacctttaatttaaatttactttgcattgtttgatgcaattgatcaggagccccaataaaaacaattttcccatgatttaatactccgattcgatcacacaactcttcaacctcggtcatatcatgactcgctaataaaattgttttaccttgggtttttagtcgtttaatttcctggtggatactgttacgtccctcaacatcaagtccagcagttggctcatcaagtacaataatatcggggtgtcctaatagcgcaattgcaagatgtaaacgacgcttttgtcctgtcgataactggtgatattgcttttttagaaaagctttaattcctaaataaataaaataatcgtcagtcacctcaagatcttgccattttgcaaataacatgattgcttctttagcggtaatatccgctggtaatgatgatgattgcagttgaacccccagcttaccatttattaaaattttacctgtatcgtatcgtcgaatcccctctaaacattctaatgtcgttgttttccccgcaccgtttgtgccaagtaaagcaaatatttcccctttaacaacagtaaaactaatattttctaaaacctgatgtttaccataagccttaccaagattattgatctgcaatgcaatatccatattactcttgctccttttggatcctcttaaaataatattctagagccgcagttagataattatctacttctttttgtttaactgccagatcattattccaatcgtcctttttatcattaaatttttgtaactctggcaacagttctaaattacctccagtaaattctaaaatcatttcccaccactgtttggcaatcataaagcattctggactatcaggacttaccccctgtttctttaacacatacagcttatctaagacttcttgataagtgctaaatattcttaacccggcctctggatcatcaccaaatcgttctttaatatgatcagtaattgtattatcaaaatgtttccacacccaatattctttatttcccaaacgaagtaactctattatttcagcatattttttaaaatctaccgtattcatttcttgaacttctcgagataaggcaatcgttgcttctaaagcttctgataagttagcaatttgttcttgaatcacacttttttgttgatttaaaatcgctgcaacttcctgtggtgtgtcgagattaaataatttagttttaatttctacaagtgaaaaaccaagatatttaaatgataaaatttgatgcaatttaacaatatctttagttgaatagagccgtcttccccctttgctaattgctgctggtttcaacaacccctcacgatcataatattgtagtgtacgaactgttacatccatcttttgtgctaattctccaattgttaagtagtcctcattcatatcatcacctctataaacattatagttcatgaccttacgtcacgagcaacaattattgaaattatttataaaaaagaactaaattaaaaggattgtcacctgtgaattacaggtgacaatcctctaattagaaactatttataaactgtcctacttgggaagttcagttcaaaacaagttcttatttttgtaaggccaagacaatcaagcgatccaataattccggataagtgatcccgaaatcattcattaattgtggatacattgaaatcttagtaaatcctggcattgtattaatttcattcaaataaattttattagtttttttatctaagaaaaaatcaactcggcttaagccatgaccatcaacagctttaaaaactttaattgcatattgacgaatttgttcttggatttgctcatctaccagagccggaatacacgttttactttcttcatcttcatatttcgattcaaacgtataaaactcaccatgaggcatgatttgaccgactcgtgaaacaattacatcatcattacctaatacagctgtttctaactcaatacagtctatgcactcctcaactacgacatgacgatcatatttagctgcctcacttaatttcccaatcaattcagtctgattatcacaacgataacatccaacacttgaacctgaacgactagccttaataaagcaaggcattcctaattctctaacaatatagtcttcaatttcttcaatctcatcaaaagtatttgttactacaactaatttttcgtcataacgttttttcacatatactgatttaacttgcggaacacctactgtatctaaaatcttttttgtatagattttatccattgctacactagagcccatcacccgacagccaacataaggtaattttgccaattcaaataaaccttgaattgttccgtcttcaccatacattccatgtaatactggaaatgctacatcttgattttttaataatccataaacatcttcaaccatgctactgttatctaaccaagtatttttagctaaatctgtctgcttcgcatcaagataatgccaaccaccatctaaatcaatcccaactaaggtgatttcgtatttattcgcatccaaattgtttaataccgatgtacaagacattcttgaaacaatatgctcacttgattgtcccccacataaaaccaataatttttgtttcatgaaaatttctcctctattttggtgacaacgtcttttaatttcattccatttgagcccttcaataagacaacgtcatcattttgtaaattattctttaaataatttaccacttcttgattatcattacaataataaatctctgccatccctgacaaagcagcactatcgctcataaacttagcttctcggccaaccgcaactaacacatcaatttgtttttccgctacatatttaccaacacttcgatgcaattgctcgctgaattcgcccaattctaacatatccgctaatacagctatttttctacgcgaatacgtagccaatacgtcaatacttgatttcattgaatcttcactagcattatatgtgccatcaatcaaggtaatgttgttttttaattcaattacatccatccgttttttagttaattcaaattgactaattccttgaatacatttttccattggaatttctagatttattccaatcgcaatcgcaacaagagcatttaaaacaaaatgatttcccggtaccgggacaacaacttgatagaccttcccattataattgattgtaaattcactatgatcatccattaaaataactttttcagctttaaaaacagcagcgcaatcaacaccgactttaacaaccttgaaattatcaaatcgaaccgttgacagcatatcattatcaccattaattactaatgtactgccgtcactcattcccgcaacaatttctaattttgcttttagaatattttcacgacttcctaattctccaatatgtgctgttccaacattagtaatcgcgctaatatccggacaagcaattcgtgataattcttccatttcattaagatgattcatacccatttctaaaatcatcacttcctcatcttttaatctcaagattgtcaatggcaagccaatattattattataattaccttctgttttcaatgtcttatactgctgtttaacaacactataaaccatatcacgtgtgcttgttttacccacgctcccagtaattccaacaactttgaccttgcgatgtttccgtaaataatgagccatcttttgcaaagcttttaacgtattatctactaagataacaacatgcttatcatcttcaatcaaccgatcagtaattatagcgctggcaccatttgtaaatgcactttcaataaaattatggccatcatagcgttcaccaataattggaatatacatcatcccgacctcagcttgacgactatcttggctaaaacctgttatttccattgtttcatcaccactaataagtttcccaccggtagcaattactatctcacttactttcatttcatccccctagaactcattacctttaatcgttggttgattttcatcatctaaaatatggcgcttcccatcaagaccaacaatttcatatccgatcacactatctgagtttcctttagttaacaccagcagcttatcacctacaacctcaaatgtcagactgcctccaatatccatcgtatataacttctttttatcttttccatcaagatccatcgtataaataatattcttatcttgaataactaatttcttctcaaccaggttcactaatgataaattattactttcataaataactttactttgtccttctaaatcacttttaactagcccatcattatttatataatataaatattcaccatcataagtataaacattagtattattggcaagattcttcttgtcgctgccatccaatgcaatcgaaactaattcattatttttattaatataaaaaattctacctttttcctcatcaacaacaatactataagaaacctcatcactaatcttatgatcctgatttgtctctaattcaagacaatgaattgtttcaccatcactatcattttgataatagactttatcaccaagattatgtacataatatacattctttaataaaatatcttctgcttttgtctttttatccattcgaatataatcattattttcatcaagataataataccactgctcatcttcactaaaaacagtaactgcttgttccaaaacaagttcgcgattattaaaactacgatcatatttcaataattcagaattcatcattaaataaacagcatcatcattaacataactaatccctaaataattaatatttgtcgcttgactatatttacctgtatttttattgattgatattttactatcactataatcattagtgattgtgtttgaattatcattctctgccagcttaatcggattattaataacatattgacgcattactgtcgtcactacaattaaaacaataaaaacagcccaaattttcttactacgccaataattttgcgctgattcattagacttaagcaatgtttgttcagtcttatcagctgcaataaactcatcgactttttcaggttcaataatctgttcttcctttataatatctacttctttatctaaccctaccggcgttccgcaaacaggacatcttttttcatgttctaataatcgcgctccacattttctacatcttttaatcttttccatttagtcacctactttaatgcctacattttaccatatcaccaaagtaaaaaaaagcgtgttattagcgtaaaagaaaagacttcgcttcaataagcttagtctattcttcttcattattattcaatttagcgatagccgtatcataaaaatcatttatataccactgctttaaatactcatcaccatttcctgtactatacacaatataattgcctattacattaaatacagttacatcataatcaatcgatacaatatgcccatcactagtcattaaatcatcatcatagttagtatatacaattgtattatttgtaacaatataattattaacctcaccttcaacaagcagttcatcattttcatcagcaatactataacaatgtacgccttgataatcttgataataaagcaaatctccactcacataaattttcccagtactagataaattaaattgtgataatttatttccggccaaatcaatagcctgaatataatcatgttcaattgttgtataaaaaactaaactatcttgcatgtcataactataatctgaaatttcatcacttatgatttttattgatgttgcacttacctcatcatatataaacagtccctcttcatcatacttagtatataggaacttatttttatctattggtaatacattatccatttcaaaaagggctgtcaattcaccacttttcatatcataacgtgcatatcttccatactgttcatagtaaagatagtcatcagtactataaatatacctttctccgtcatctacaagcgatttaaagttactaaaattccgttctgtttgatatatttgataatccatcccaaaataaatatttgaatccgttaaaaaagcataaccaccattttttaaatttccctcttgcgttatactgctattactatcaaataattgtaatgttgataattcttgataatcccgttgatcattcgaatttttaaaaatttgcccgaaaatagttactcctgcaatcaatatcactacaattccaactataatatttcttagtttttcttcattattagcagccttcttttttatgattggaaagcccatgctgttaattcgctgtctagcttcttctaaacgttgtttgatttcattattgcttgatttgtaatcatacatctcttgttggtggtaaacatggcttttttcactatgtttatcgcattctttattatttgttgaattatttatgttaaaactactgacgtacttcttagtgacatcagtcttcttttcatactttgttggattcccacaattagggcatcgtggttgaccaaaatgtattgccgctccacaaactgagcaatgacttatcttcccctgacgatgaccacataacggacattttaaactatttttatactcatttccgcaattatcacatctcattgtacctcaccccctattaattatattgtaccatgcccctatttagagtcaatcagccaaataatataaataatttttatcaaaaataaaaagatactgtcgtatcttcttacttacacattttaactccggtttctaatatttccatttgcaataaagtttgttcatctttgacccgaggttccttaccctcaataatactttcatataagccatcaaaaacatttccataatcccctacttcagagatgactttttcttcatgaaaaacacctgcatcatcataatacgataacgttccataatcttcaggactatcaattccaaaatttggtgaccccggcatataaaataacttgaggtgttcttcttgacgatcttttgtcgctttaacaaagcatcctttatcaccataaacaacaaaactaggacgttcttttactctaaaataacttgactttactgaaactttaagtgttccataatatagatccaaatcaaaataatcattcattcgtcctgatcctaataattgtcttacatcataatgaatcttttcaggtttaccaaaataagaaattacttgatctaaagtatgacatccatgaccatataaatatccattgtacccaacatattcatgaacatttagtggtatttccggacgataatagtcataatgcatttctacttctaataaattacctaattttccactttcgatcactttttgaactgttaaaaaatcagaatcataacgacggttttgatagcattgcactaataaccctttttctttagctaatgcaaatatttctttagcttcagcactatttttcataaaaggcttttcaaccaaacaatttttaccatgttctaaaaccattctagcatactcataatgactatcatgacgagtgcaaacactaatcagctgaatctctggatcgtttaatagactatctaaatcatcagtataatttattcctgcaacacgtgaccaatcatgtttatttaaatttcgagcataaatagtttttactttaatattttttcttgtcagtacaaatggcaattgataacgattagtacttttaccattgccaataaatcccattgttaacataatcttctccttctactttgatatatcatattgtactatattctaatcattaattatattttttacgataattgaaaagatgattttaaacaaccatattaataaccaaacataataacggaattgtaagtaatgatagcgctgttgataaaaagacaatttctactgccaaatttgaatctccatcatacttctcagccaaaattgctgtcgtacttcctgctggcattcccgccaaaactgttgctactgcagttactaatggtggtagattaactattgcacaactaaataagaccaataaaggaattaaaatcaaacggataaaactatagtagagggtcaatctatttataacatctctaattttgatttctgccaagattccacctattacaatcattgataaagccatcgtacaattactaagtgactggattgatacttttaaaaaacttggtaattgaatttggccaatcataataaacaggccaataaatactgcgataatgcaaggatgtgtaattactttcttaataacatctttacctttagcattagtaaaacatgcaaccccaccagaccacattacaattctttggggaattaaataaatggaagcaaataataatccatctaatccataaaggccttgaatcaagggtgagcccataaatccagcattggagcagatcgttccgtattgtaaaacactttgttgtcgttttgttgccttaataaagaaatactttccaaatacttggcaagcaaactgaataataatcgaaacaatcaaaattgttagaccactcttgatgatttgagtatccattttaatcataaaagagtaaataatattagccggcagtacaatatatattactaaatccgtcaagctctttcgatgctctttagaaataatatttgtctttcttaaaatatatccaattatcattaaaataaatatttcaaattgtaaatccattaaattattaaaatcaaccacaataacacctctttgaagatatcttaaactaattttcttgacacgtcatctaaaacttaccattattcctataattagttataatataaacaataaaagtaagggtgaaataatgaaaacaaactacgtctatatcgtcaaatgtcaggataatactttctatacaggctggacaactgatctagtaaagcgaatcaatgctcataatcatggcaaaggtgcaaaatataccaaagctcgtcgccccgttgaactggtttactttgaggagtatactgaaaaaagccttgcgttgaaacgggaatacgctattaagcaaatgacacgtaaagaaaaagaattattaatcaacagttagcataggctaagtaatttctttggaaattaaagaataacgtgttatactagattcatatagaaagaaggcaaaatatgaaattaaaccgaaatgatttatgctggtgcggcagtcaaaaaaaatacaaaaaatgccatctagcatttgatgaaaaattagagcaattaaagcagcaaggaaaaaaaattccaacccataaaatgataaagacgcctgagcaaattgagggaattaaaaaagccgcagtaataaactcaggtttattagactatattgaagcaaatatcaaagttggaatgacaactgaagaaattgatgttatggcaaaggaatatactgccaaatatggagcagtttgtgctgattatcaatatatgggttatccaaaacatatttgtgtctcgatcaacgatgttgtttgtcatggtattcctaatgagcaaactattttacaagaaggtgatattgtaaatgttgatgctacaaccatgctgaatggttattatgccgacgcttctagaatgtttatgattggtaaagtttctaatgaagctaaaaaactagtcagcgatacaaaaaaggctttagaactcggtatggctagtgttatcccctatcaaagttgtgttggcgacattggtaaagcaatcgaaacatttgctaaagctatgggttatagtgttgttagagaattttgtggtcatggtgttggtttagcgattcatgaagatccttatgttttccattttgagccaaatgtgcctactgttacccttgtcccaggaatggtctttacaattgaaccaatgttaaatcttggtggtcgtgaagtatatgttgatgagtcagatgaatggactgtttatactgatgatgaatcactttcagcacaatgggagcatacgttgttagtgactgaagatggtattgaaattatttcaaaataataaaacctccgatttgaagtgaaccgccattatttagattagacacctaaataatgggattcatttcagtttggaggtcttttattttatatttataattacatactcactaggagcacctgttttgattggataacgccatcccgctattcctgtcgtcgtaattgctgtaaaatcaccgatatccctttgtccacgaatcaacgtatcacttgtcaatgactgaacaattcccatagggaacaattgtccaccatgagtatgcccagataattgtaaatcaattcctagagttgcattttcatcaaggtttaaaggctgatgatcgagcatgatcgtgtagttaccacgtttattttcaggaatcatctctaataattgactagttgacaaacgaggatttgtaccccaaaaacttgcatcttttcgaccaataatatttatattgtctaagctaactactgcatcttccaatacaacgattccatttttctccaacgtagcacgaacatcttcaggaccaaattcactatcgctaaaagcatgagagccattgtcatgattaccataaacatagtagattccttgttgattattgatcgatgctagcgccttactagcattaaccatatcatctaatggggtattttcatcaaagatatcccctgttaaaactactaaatcagcattcagctggctcatttcatcacaatatttttgtagctccgtaacacttaatgatgttgacatatgtaagtcagcaatttcaagaattttaagatcctcaactttatcactttttagatcatatgttgtagctacaacatgtttaatattatagtagccataacctaaaaataacgccgtaactactattcccaaaataccagtagtaaatgaaatccgataaatcgggaatctttttaagcctagatttaatagctcaaacaacaacatgacaaccaataaatgataataaataaccccatataactccaacgtgttcattgctggaattgatagcaccattatcactaatccaattataataatgaggaaccaattagtatgaatatttaaaatcgttcgtaataaacggttaataaaaaaagtaaaataaataataccgggtataaccgcaagcaaacccatatataagtacataaaatccctccttttaatttagaatacacgctgaagtatgcttcaggtcaagtaatttttataaaacacatatcttcacatatttatattctaacaaaataaaaagagcatataacaacataatttactaaacaaacaacaaaaatattccaaacagtcttaaacattaccagctttatcctactctctatttttaccgtactctctttttattacccaacatattactaaaaataattaataaatcatatttccttaacaagaaaattttagtttgaataacttatcaaattatcgtaaaaactataatgatagcaaagctatcaacacatttatcaactagaaagagatgaaatatgaagaaacgtttcctgatttttttactaattattgcaccattatgtatcaatgctgttcatgccagtgaagataatgctaaacttcaattattaaaagagaaacattatgaaactgaaggtacaatcgttactgtcaagattccccatgttgttaatgttaaagatgacaaagtaaaaaaagttattaataagctgattacccaggcaattgatgactttactaacgaatttaaagaatttgacaaagaaccaaacacagaacataaattaattgcagatattactttccaaaactactatagtgacgataaaataatatcattttcaattaatgccacccaaatcatggcagacagctatttacaaaagaaattttatacagtagatcttaaaactggcgaagtctacaatattgaacatttcttaggttcagattatcaaaatatcgttaaaaaatctgtacaacaacagattgcggagaataaagaaaaatatcctaacctaatgtattttgatgaagcggttaataatttaaagattactaatgaacaaccattttatatcaacaaagataatcaggtagttgttgttttcaatcaatttgaaatagctcctggttatatgtcattaccggaatttattattaaatagttgataaatctagaggttaaataatattttaacctcttttatatttgtaaatcatttatttaaaaaatatccacgacatgtctaacatcatggatatttataattagcaagtggtatattatttataaactatattgttaacaattttattatttatctgcagcaaattctattcccgcactttgacgagctttagtcgcaatctcaatagtaatcaaactaatttcctgcatttttttagcacgagtaaaatctttttcatcaatcattttaacaaattctacaaattcatgatacatccgatgtttatcattattgtaagaaacctcatcaccttcattattcatttgtttagcactacccttattcattaatactttaaaaccatttaagctattagcaggtgtagaaattgtaatacatcctgcatcaccttgaatatttgttgcaacgggagctttacaatctttagctccaatacatacacatttaaaactatcatagtctaatgttaaaattcctgaagtatcaattcctctttgaatatttgcctcataattgacatttaatggtttaccaaataaagctactactaaatttatattataaatatttagatccattaatgcccctcccgacatggctggattaaatgctggcaagacttctcctgctttaaaagcatcataacgtgatgaatattgtgaataattagcactaacgatcttaatttgtcctagtgttggtaataactctttaatttttaaagtatttggtaaatattgggtactaactgcctcaaccataataactttattagtgtctgctaaagcaaccaattcttctaattctttaagattagaagtaaatggtttttcacagattacatgtttaccggctaaaattgcctttttgcacatttcataatgtaaatgattaggcaccgctacataaactacttcaacctcactatcttccagcattacatcaatatttgtataatgcgctttaatattgttagcttggcacatctcaacaattttttctttttcagccggtgtggcacataaagcaactaactccataccagtaacttcatgagcaaaagttaaaaaatcatgaacgatcataccggccccaacgattccgaccttcattatttagcctcctttgctactttagttgcttcttcaataatttttaaaacttctattacttcctcatcggcaactaatttatgagccccatttacaataacatcatttaaattgtcataaataattccataatccccaatttctgtaggtactttttttgtaatatcattgccattatcatcaatgtaagacaatgttccccacttatcttctggtaatggatcaaatgatacatggatcgctcctggtttaggtttttctgatgaattatgaccaagtgccggcattaaaaaacttccttttttgccatgaacgataaagcgtggataatcaagttttacataataactagttttaacaattgctttaaatccatcataaaagaaatcaaaatcataataatcatcactgactccaggattatcaacactacgacagtcatatacaactcgattaggtttaccgaattcaccaatgatttgatcaattggatgaactgctaacccatataaaattcccatacctttattatttgctattgatggtctaaaataatcataatgtgactcaatttccacaatgtctccaagtacacctgattcaataactttacgaactgtgcgcatatcagcatcataacgacgattttggttagccattgctactagacctttttctttagcataatcgaatacatctttagcttctttagcggtcattgcaaatggtttttcacataaaacatgtttaccatgatccaatgcctgcattgtatactccacatgataacgatctggggtattaacaactaccaagttaacatcaggatcatccataatctcattaattaaactagtaaacttaatcccaggataccagctctctttttcttcattaatttctgtttctaaacgataaatatactttacatcaatgaagtcttttcttttttcaacatatggtaaatgataacgacaaacgctgttaccaaatccaatataagcaacttttaacatctttctttcctcctattttataggtttattttatgatgaaaaaaacctataaaacagtgattttccagctcttgcaattgaatttcatacatttatttacagtactgtaatttaatttcatactactaaattaaattaatcaagtagcggaaaattttaaatattttccctctcttacaccactgtccatacggttccatatacggcagtttaattaaatttcaatttatatctcaataaataataatctaaacaactaactagtccattgtgtgctagcctttcttttgctacagcacgcacaacacatgttctagttatcacgaattgatagcatatgatatttgtcttgctctaccataatttaccccaagttttctaacaccatgactaggctttggaatttcaatacttttaacaggttgtggtttgtaagaccttgtttcaatttgtcttttatttcatcattggctacattatccacactacttgtgcttttatagacaagtatcatatttttcttagataagacttcctctaataatttgtgtgatcttctccttttcgctttctaatgcctagatccaagtgtatatgcccttcggctcaaatacatttccgatgcactatgtgattcgtcgacaactacattcacaaaggactttcaccctagatgtatgacaagtcgtcatacttaaaaaagatgtctctaacagacatcttaatctagatcttttccatccgatttaatcgctttttgataccaataaaatgaatccttttttatccgatgtaaatcaccaactccatcatcattcatatctacataaataaacccatatcgcttatccatttgtcctgttgtaaatgatactaaatcaattggtgcccatgatgtataaccaaaaatattaacgccctcttcacgagctttcattaggctctttatatgactgcgatgataattaattcgataatcatcatgaatagagccatcatcctccacttgatcatgtgcccccaaaccattttccacatcaaataacggtacttgatatcgatcattcagtacatgtaaaaaatattcataacctgtaggatcaatttgccagccccaatcagatgcttctaaatatggattggctaaactaccctgaccacctgctgttgctaagtttccctctacatcatgcgtagtaaatacatttgacatatagtatgaatatgctagaaagtcagatttaccttccattagaatcttcttatcttcttcactaatttctaaagatacattattatctttccagatacgttttgcataagctggataatatccccttaccatcgtatctgcacaatatgcaaatttttcttgaaacaacttatatgaacctaaaacatcttttggatcacacgtatatgaataacagcagaaccctgcaatcatacaaccaactttgatttcctcatctatttcatgagcagcttttaccgcttctgccgccgctaccatttgattatgtaattcttcaaaagcaaactgttttccttctttaacattaaagtgaagcaaaatgttaatttcattaaaggttaaccacttattgactaaatctttatattcaataaaacatactttagcaaattcaacaaactgatgaatcatctctctatttgtccagtcaccataggtttcttccaaatagactggttcatcatatttatacaaagttataactggatcaattccatacttcctacattctttaaaaacattacgataaaattcaactcctgcttgatttactccaccttcaacaccatgcgggaaaattctagcccaagaaatcgtcgtgttaaaagttgtaaaaccaagttcagcaaataaggcaatatcttccttatatcgatgataaaaatctatccctacatgatttgtatatctaacatcatcaaataattcatattttgccccctttggtaaatgatcaaattgtcgcatttttcctcttgtaccatcagcatttaaataatgaatataacgattattagttgttgttccgggatcaccgaaatctacttgaaccggactcttaccatcttcatcccatgctccttcacattgagccgcactaatcgaaccgccccataaaaatttatctggaaaactcatctttattatcctccttaagccttcttttatttttatcttcttggtgttgccatttgcgcccaagtatacgcctttccttttaaagtgattgccatttggtaaatattttccggccaggttccaccaccaaaaccaccatcaccaatagcatgaacatcacatcctgtttgtttcatcatcagtgttatttgacgaattgtatcaacatctgctgcttcaacattactatttaaaaagctcatagcaagagccccatttcgatgcgtaaattcaattaattcacgaatcatctcaactgtaataccgtggcgtgagcccggagcaggaaaatcaataatatcagccccagcctcaatcaactgcttaataatatttttagcatcataatcagcaagtggatcacctaatactttttcactaatgccatcctcccattttccagcaaaaatcagcatatcatcaccacaaatcgctctagcctcttttgtccacttaatcacatctttaattgatgtaccacttcccggattaccacctaaaatgagaaatgatacaccccattgttttgcctttaaaagattttcttttgtacataccatacctgctagatcgtataactgagaattctcttggttattaaaatcaagcccttctttaggacaccccaaataaattcccactggtctaccacctactaaatccttcaattcttggtaatcaaatccttgcatgccaggacaatcagctggatgaaaaaaatcaaaaccattcaataaaaccatatccgcaccaaaagcaaacattaattcggtactggtacaattaggaaataagattggattttttaaatacgtttgtcccatcagcaccctaccttcagatttaaaaattgcttcttttaattctctaccagtataattagaaattttactagcttttgcactaatcaatctagttacttgattatgtagttccatcttttttctccttatatctattttcttacaactaaatcttaatttaaaaagtagtctaaaaaaatcatatatagatattttgtaattaaatttcaaagatataaataattatgaaatttaatttcaaaaatatcattagtagtgagaaaacgttttctctatgtctattaatatgttaaaatataagtataaataatccctgaaaaggagtgcataaaatgattcgtgaattaatcgatagcattaaactgacaaaaaaagaacaagttatttccgaatatttagaacaagagcctgattgcgtgcttcaatataacgctaaagaattagctgctttaatcaaagttagtgcccccacccttattcgctttgttcaaaaattaggatttaaaagctatagtgattttcaagtgacttacacccaagaaaaaacaatgtatgatcaaatgaaaaatatacggattgattcaaaaagttctattcgtgatgtaattgaaaccctacctgcaatatatgaccatgtttttaaagaaactcgaaaactaactcgttttgaatcgtttgttcgaacgataaattatatgctgcaagctaaacaaattgatttttatgccaatgacaataattattcagaagttcaatctgcctgtttaaaactaaataccattggtatcaaagcacaatgctttaacactttgaatactgcctatattgataacatcgatcctcgagacatcttagctttcgtagttagtcactcgggaaaaaatcaaacaatggtcgatgccgcatatgaactccgaaaaaaacgaatccgtgtcatcgcaattacaggaaaaatcgacccaactttagaacttgtatgcaatgaagccttgtatattgattcatcctcacatcatctgcctcatcatattatgctatatggattatcgatacattatattttagatattcttgttacctcactttattacaaaaaatacaaagaataataaacaagaccttacgctcccgtagggtcttatttaaccaacatttccttgatgctgcaaagataaatcagtatattgcataatttcaaatttatttccatccggatcatgaatccacatttgccaagtttctgattgacctttattaggctcaatatcaatttcgataccagcttcaatcagctcttttcgtgcttcaaaaatatcatcaaccattaaagcaaagtgtgaataccctagtctaacatctggcttttcatgttctagctggttatctgctttattaaataattccaaatattgtcccggggctaactcaataaaaatataagcaatcccatctggatcagtaattgcttttttagcccaagcaccacggcttttttgtccaagataagccccataacgcataattattttagcttttaatcctaatttattttcataaaaatctctcattttatccatctgatcagtataaaatgaaagatgcatcacttcattaaatttcatttttaacctcgcatttttataaaaaggtctgtttaaataaaacaatcaaagctatttaaacggaaaaatagatttcatgactatctaaacaaaccatttttattatttattttccacctaattttaaagctgtatccaagaccttagcaccattcattgtcccataatcctgcatattaattatttcaaccggtttatcaagaaacatttttttaacattctttaattcataacgtacttgtggtcctaataaaatatcatcagctgcttcaccatatttttcaatttgtccaacgggatgggcttcgatttgaaattcaatttcttttgtttcggcagtctctttcattctattaactaatagacttgttgacattcccgttgcacacactaacaaaaacattcatcattattccccctctagcctaatattcaatattattctctaaatcatcaccattggtagcaatacattttttataccagtaaaacgattttttaggataacgttttaaatcttttaagtcttcaaaatcacgatcaacataaacaaatccataacgttttctaatttctttatgactacttaaaaaatcaattggactccaagctaaataaccaattaaatcaacaccatcatgttcaacagcctgtttaattgctttgatatgctgttgataataatcaatacgttgatcatcatatactttttgatcaattaactgttcatcaattccaataccattttctacgataaacaatggtttatgatatcgatgataaaaatcaattaacgaatatcgtaatccctgtgaatcaatttgccagccccactcatttgcttgataataaggatttttaagattgcgctgatcaaataaaatagcatcctctaaagtaatcacatcatcaatttcatcaaatgaagcctgaacactactgcgataatatgaaaatgctagataatccagtttggtcgatgctgatttaattacctcttcatcagctttatttagactgattgttatatttctatttagtgcatactgcttaaaataatctggtagttctccttgacacatcgtatcaaaagcaaaatagttgtgtaacttatttttaaaatctgcagcaataatatcactacttttacaagtgagtggatagaatggtgcatgcccaatcataccacctactttggcttgtggatcaacacgtttaattacctctacagcacgagcatgtgcaatttgtacattaatatttaattgtacgaacatctctgctttagacattccatctggtaaataagctcctgccaccagatcactttgacaataagctaaattaatttcattatatgtcagccagtatttaacttttcctttcagtctagaaactaccgcttcaacatggcgagcataaaagttaattacttctttgttcataaacccattatagttttttaacagataatccggcatatcaaaatgaactaaagatactactggttcaattccttttgataaaagatagtcgaccatcttttcataataagctaaccctgcttcattaggactttcttcattaccaagcgggtgaatccttgaccatactactgaaaagcgatatgctttatatcccatttgagccatgtaatcaatatcttcttgataatgatgataatgatcagtagctacttttgtatcacaaaacatcggttcaatcccgggttctggagtaactactagagtgtcataaacatttaaccctttaccatcttctaaatatgcgccttcagcttgaacgttgcttaaagcaccgccccataaaaattcttctttcatgatcttctcctttatctcgttgtcatcataatagtcatatgaccatcaaaaacaattttgtttccttgcggaatcaagaaattatcaccgactttaataggcactccatcaacagtcccagagcccctcacaaccgtcgccaactgataattatcatgataatagtgattctctcctgtaagttctaattttgttacagtaaatgagtcattatcaataaaaacagttttttcaccattttctaatgatgtcattacagtcgtaagcttattttccatctccttttgatcataagacaaacattcaattgcttcttttaaatgcaattcacgttcattgccatttgcatctttacgatgataatcataaaaacggaaagtaacatctgtagcctgttggatttcataaacaacactccccttttttaatgcatgtaataatccagccggaagatatacaaaatcatcaggatggacttctaaatgacgaatcagtttatcccactgttcttccttgatatagtgagtcaaatcagcttcatctttggcattgtgtccataaacaatcttggctcctggctcagcttcaataaaataccaagcttcatttttgcctgcttgataacctaactttaaagccgcttttacatcaggatgaacttggatacttaaatcatcttctggtcctactaacgaaataataaccggaaactgttcattaggatgaccaaataattcttgatgctcctgccataattctaataaagtttttccttgatatggtgcagtctcacaaatatttgaagcccctttttggcagctaaatgaccaagactgtccaactccatccggaaaatcatgatagccaaaataatctttaactaacgtatgtccccatatagccaagcgcgggatcggtttaaaaaataatacacccataatttttctccttataaaaaataggcattaatatgcctatagtgtaaacaaagcaaataaaccaattacagttacaaagattgataagcaattagctaatgagacaatattagctttgattctaaaaccatatttactataaattaaattatttacttgttttgccttagtgacatgataatcacctaacaaagcaaaaacaacgattacgattcgcattggtaaacttgttccaattccatcaccaaaataattccatggtacaatagctaaaataagtgctaaaactgaagcaaataaagctgcaccaatatatggatttttttcatctcgatgcttttccattcgttcaatatcttttttagacatcttttgttttattttattatcattatatttttgagcataactacgttgttcaactttaattacttcactaccacagctatcacaaaattttgcagaatctttaagtacagcaccacattttcgacaatacataatatccacctgctctctatttcaaaataacttgtgaaaaattaactaaactaacaaaaccactaataacgatcgatacccaagcataatttttattaccatttggttcgaatcctttttttcgatcctgtttatctacccgcaatgacaatacaccacaaacgattgccccaagataagcaaacgaactaagaatatatggaatctttacatttccaccaactgcactaaatattgttcctgcgataaaatccaatccaattaaaccgataaaaaataggaggatccctaatttagcccagctattttcacggggattcttttttaactttgatttgtttttttgtttaagtgcatctgcactaatttctttaccgcaatgataacagaaagctgaatcttgtggtatttccttatgacaatatggacattccataattagttcctccttatttttttattaagagaacttgttaaagttttcttaattaattaattctatgcctctgcagtattcattttagcaacttcagctttttcataagctttccagaatggatagaagataactaatccgattgctagattgataaatacaataatgataccaccaactgaaccaccagcagataaataacctaagattggtgaaggtgttgcccaaggcaatgacatatacatttttcctacaaaaccaatactagttaaccaataagttaaagcccctgttaatgtatgagttaaaataaatggaattaataggaaaccattcattactactggtaacccaaacataattggttcaataatacagaaaattgcaggtggtaaacagattgttgctaatggtttcaaatgaggtaatttcttactagacataaacatgtaaattaaaattggccagcaagatgatacccattgagatagacgacataagtttggtgtccaaacatatggtaaatctttaactaatgttccagcagtaaaagcagtgttgttatcagcaagccattgatttgtaaagacattagtaactgcaccagtaatattgtcaccatgtagaccacacatccatagcaatgctgataagaattgctgcaagctataaacaaagacattgtctgccgctcctaagactggtaataacatttctccaaccaatactggaatattgattccggctaaagttctaattccccaacatacaatcgtaataaagaaataaggaataattgctgagaaactatctgagatagcaggtggtactgaatcaggcaatttgattacaatattcttttttaaacatatattaataatattaattgcaattgctccagcgatcattgctgtaatcaaacctgaaccaccccaataagtactttcgaaagcactgcctccagcacttaaagttccatctttagcagtgattactaaattaccaacagaatcatagtttaataacataaaagcaaagaatgctccgactgcccctgtagtcttattaaatcctttaatttctgcatattctcccccgaaagcgataataatgtagatagccataattcccattgataaactattgactaatgcaagatcatcagcccaaggctttaaaaatggaattaatgctttagttgtcaatccaccatctgaacagaataagtatactactaagaagattgacccaaccattgttactggtaatgctgcgaccatcccatttacgattgctcgtacaaatgggatctgtccaaatcttgtcattggtccagcgattacatcaactttttccaatactttgtccatgaaggactttttttcagtagacatattttttcctcccttaattttcaaaaacgctttaaatgtaaacgttttctctttgtctatctatatagtatacccattcacttattttttcgatatattatcctgtcgtaaattatgccatttttatttacaaatacctcaaacccattggtattattaatgtttttagaaaatagaagtcttaaaaaacaatgagtaaacgtttactttttttactaattttgatatagttttactagggagtgaccatatgaaactaaaaaaaaacgaattaaaaattattcaattattattagcttcaccagactacatttcaacctacgatatcgctacctcgacaggaattcctcgtcgtttagtgcgtgatgaaattagtaacgttagagttattttgtcatcattaaaccttaatttattatccaagccttcaaaaggttattttatcgaaggaaagtcttctaaagatttaagccgattgcaaaacattattaatgataatgagcgtgatgaaaataatgtttttccaactttaccaaaagatcgtagaaattatattgcaaaaagattaattgaagaggccagctacattaaattagaaactttcgctaatgaattattagtaagtcgaccaactgttgctaatgatgtccttcttttaaaaaaagatattcataaatatggtttaactttaattcaaaaaccaaattacggtattagtattcaaggaagtgaaatttcaaaaagaaaagtcttagctgactgggtttttgaaaacttaacacaatcagatatgtttggtgatttcttggatgcctattttaattctccagattatcaaatcattgagatcattaatcagcatcaaatcattatgagcgatattagtttgattgactttttaatttgtttctctatcgctattgcaaggaatacgatcaatcatacgattgatagcccaatcgctaatttcgagcaattcaaggatcgttttgaatatgctactgctaaagaattaggaaaatatgttcaagaacgttttaaaattgatttcaatgaatatgagattcaaaatattactattttattaatctgtaaaagatcatcacgcggcttatctgcttctcatgatgataatgtaattaccattgctaatgaaattctagcgagaatcaaagcagaaacattaattacttttgatactgataaattatttagaatcctatcgctatatattgaaaatactttgatcagacaagcatatgttgaaaaaatccgtaccccggtatatgaaaatattcaatatgaatatcctctaccatatcatttagcatctattgcatcagcaacgattcaacaacactccaagataaagttatcacgtagtgaattatcggcttttacaatactctttaataatgctattaacaatcaaaacaagaaaaagaaaaaagttttattgatcaattgtatgagtggttctatgtttacactacatcgttatcggattgaaactgaattagcagcacaattagttattactaaatatactcaatattatcgaatcaatgaggaggacttaagtaattatgacttaattatttcttcagtaccgattcgtaaacaattatcgattcctgtaattaataccagttatatgattactaatgatgatatcattagaatcaaaagctatttatcttatttgttcaatgatgaagaccttgtttattattttcatccatatctatattcatccaatgttaaagtcaaaagcaaaaagggcgtcgcctcaactttctatcatttattaacatgtctttatccaaatctaaaagatactttcaaatacgagttaaataaacagcatcgttatactttgaacactttcaataatgtgattgggctaataaaactaaataaaccaatcaatgccaataacaatatcgtcgcaattactttaaatgaaccaatcctgtttgatcagcagcaaatgcaggtcattatcctcttttcatgtttagacaataataatattatgtataatactttatttaatacgctgaaaaatgttgctaataatgaacttgatgtaaaaaaattattatctcacttatcgtatccagagtttctcagcgtaatcaaaaacaacaaatagctttaaaagcatttgttgttttttcattacactttattttagctaagaattatattatcaatggcagagattattagtacagggaggcactaatggacaatacaattcactaacagttatttacttttttgtctttcttcaatttctttcaacatatcgattctaacttgatgacgcccaccttcatactcaccagttaaccaggcatcaacaatcatttttgcaagttcaattccgttccgtagctcagtcggtagagcagaggactgaaaatcctcgtgtcgctggttcgattccggccggaaccaccattgatttggcctgttggagaaacggttaactcacatgcctttcacgcatgcattcacgggttcgaatcccgtacaggtcaccatttgaaattagcaacctttgggttgtttttatttttgattatgatatactattgaatattaataagaggtggattcatgaaatataaagagtttagaatgttaattttttcaattatctttttctttgtgattggcggtgtgtgtgtttattttgcactagatcataatcgttcaaaagtgattattggtgtaatcttatcgtttgttgtattaatgatgttaacaacaaaatataatatgaagatatttaatgattcgatgctagtttatgaatttaaaggaattggaatcttaccagctttgatagactataaagatgttaaagaaataaaattagtgagcaaacacaaagttaagataaaacataaaggtatttcaacactttatattttagatgctgagtcattttatgaagaagtaatggaaaatatcgaagaatataaaaaaagcgttaatcaagaagattagcgcttttatcttatctattaataaattccttgagaaatcattgctgcaacaactttttcaaatccggcaatgtttgcaccttttacaagatcatatccaagaccgtatttttcagccgcagcttttgaatgatcgtgaatgtctttcataatttgttttaatttagcatcaacttcttcacgtgtccaattataacgcattgagttttgagccatttctaatgcagaaactgcaaccccaccagcattagcagcttttgcaggtcctagagttccaccgttactaataaagtattccattgcttcaggtgtagtaggcatattagcaccttcaataatgtatttaacaccattagcagttaattgtttagcttcttctataccaatttcattttgtgtagcgcatgggaaagccatatctacttttaatccccaaggtttttcaccagcgtggaattcacatccgaatttttcagcatagtcttttagtttaacatcatttgattcacgaattttacataagaaatcaattttttcatctgtagtaattccttcaggatcatatacatatccatcacgtccagaaattgatacgactttagctccaaattcacgagcttttaaacaaacaccccatgctacgtttccatatccagaacaagcaattgtttttccttcataagaatcattgaaatgttctaatacttctttaccatagtagcatgctccaaatccagttgcttcgggacgaattaaacttcctccatatggcaatggcttaccagttaaaacaccattttcaaaagcaccacgaatacgacgatattgaccatacatataaccaatttcacgggcacctgtaccaatatccccagcaggtacatctacgtctggtccaatatgacgatataattcagtcatgaagctttggcagaaacgcataatttcgttatcagattttccttgtggatcgaaatcagatccacctttaccaccaccgataggtagtgtagttaatgcatttttgaaaatttgttcaaatcctaagaatttgataattccaagatttacactaggatgtaatcttaatccccctttatatggtccaattgcacttgagaattgaacacgatatccacggtttacttgtacttgaccatcatcatccatccaaggtactttaaacattaaagttctttcaggttctactaatctttcaagaatagcttgtttttcatattcaggatgagcttcgattacaggtcgtaagctttctaatacttcttcaactgcttgaataaattcaggttgatcagcatttttttcttttacttgattaaatactttagtaatataatccatttttatattgtcctccttcttgtatatttaatataatactattagtctgataataaataaatcatttaagaaaaaaatattataaataaatataattattatattgcataaaaaaataccatctttataatattgtcttttaaaatactatttgtatatcaataaatacatagctgctataaagagagtttccaatatagtgagctaataagttaataaacttattttttgtatacttagcgtgaggattaaaaataaaatttattatttgataataatagatttttctttgtgaaaaagggcaaactatagtagaataaacagtggattctttttagaaatggagtgttaaaatggaagcagcgggacatgtatatatggcgattgatttaaaatctttttatgcttcagttgaatgtattgaaagaaatttagatcctttaactactaatcttgttgtagctgacactagtaaaacagagaagacgatttgtttagcggtatcaccatctttaaaacagtacggtatttcaggccgagcaagattgtttgaagtcatacaaaaagtcaaagaagttaattttcaaagaaaaagagcaattaacgacagaaattttatagataaatcttattttgattctcaactaaagaaaaatccttatttagaattaagctatatagcagcatcacccagaatggctttgtatatggaatatagtacacgaatatataacatttatttgaaatatgtatcacctgaggatctccacgtctattcgattgacgaagtttttattgatgcaactagttatttgaaagcttcaagaaaaacacctggagaatttgctaaaatgataatattagatattctagaaacgattggcataacagctactgcaggaataggaacaaacctatacctcgcaaaagtggcaatggatattgttgctaaacatgttaaagcggatgaagatggggttcggattgcctatctagatgaaatgcgatatcgaaaatatttatggcatcatcagccgattacagatttttggcgaataggacgaggttatgaaaaaaaattaaagaaaataggtttatttacaatgggcgatattgccaaatgttcagtgggcagtgaagatgaatattataatgaagaccttctttatagtatatttggtattaacgctgaattgctgattgatcatgcttggggatgtgaaccttgtacaatgcaacatattaaggcatataaaccagaaaataatagcattggaattggacaggttttgagttcaccttattcattcgaaaaaggtaaattgatacttaaagaaatgctggacgcattagcattaagtttagttgataaaaagcttgttacaaaccaaattattattactattggatatgatattgaaaatgtaactacgggtagtctttatcgcgaggaaataattaccgatagatatgggcgaaagattccaaagcatgcccatggaacaattaatcttgatagttatactgcatcagcaaaattaattatcttggcagttttaaaatggtatgaagaacatgttaaaagattcttaacaattagaaggtttaatatttctgccaatcatattattgatgaaagcagtattaaaataaagccgacaatacaacaaatggatctatttactgattatgatcaacaaaagaaagatgaagaaaaacaaagacgtgatttagagaaagaaaaaagacttcaaaaaacaactttggagttaaaaaagaaatatggtaagaatgctgttttaaaagggatgaacttagcagaaggagcaacagggagagaacgtaataaaacaataggcgggcataaagcatgacaaaaaacattcatgactatcaagatattattaatttaccacatcatatttcaatcaagcatccacagatgtcattagaagatcgtgcagctcaatttgctccttttgctgcactgacaggacataaggactcaattaaggaaactgagcgactaacagctcaaagaaaaatcttggatgaagatcgtatagcaattattaatttcagattacaacaattattaaagcatcttactgaagcaccgttaataaaaataacatattttgaagcagatcaaaaaaaatcgggtggacaatacattacaattataaatcacctaaaaaaaattaacgaatatgaaaatttattagtgcttgaaaacggtgtaaaaataaatattgatgatatatacgagcttgaataagttaatgtttattatgagataagtttattttagtaaaaaaatattgctattttcatgtggctggatgtatataatattttagttttaatgataattttatggtatcaaaatagagatgattagaactaatagctgttagtttatctaatcatttttatttttgaataaaaaattgtatacttaaattgattatttaaataattatgaaagttgagaaagtatcaatgagatctccatattgtgctagcgagatgatccttggttatatttattcggggaaaaatgatatttgttggattccggataatgaaaaaaatagctggattattaatcatccaaataaacagcaggttattttagcaaaattaaatttgataaaaggctgtcgaattaaagtatttagatgtgctagctgtcaaatagagattattaatgaaaaagagttataattcgcttattgaaaagctgtaaaggagagaaactatggtaaatattaagaaaattattaagattatttcttggatcattattgctcttttaggtatagccttgttactaaattggcaaacaattgaatcaccagtcattattcatgctgatttgtcagggaatttctcttatggtaataaatctacacttattgttttctatctaattatagttctaataaacttattatttacatttaaatatgagataccattgatgaaagaattgcataaaatgattaaatcctcgttagtgatagatataattagtatattttttcaatttttgataattgttgttataggagcatttatagttaaagccataatttaaaaagtataattaaatcaagtttccctaataagggaatttttttatgacgtatattcagaaataaagaagactaggttttgttactttgtcgctcatttaaaactacgatttgttcaaaaatactgtcaaattcaggattatccagattagtataaatttcaactttatacttaattggagcgacttcaataaatcgattcattgaatctaaaacgaaactatcaaatttagctaaatcaatgtttgaataagttttattaattttcaatttagcacgaagatactgtgaaataaaatatctaatttgagcaatatgaatttttttcaataaaccaatattatcaaaatagtcaatgctgtgatcaaattcatcaccattatgatcgatcatgtcacataaagtagaaacttcaatgtttaatttagcattaaaaaaaggaatttcttctaaatatgcaatctcatttataagccatattgcttcaaataagctagctttaagttcattattgtctaactcatttaaatcaattagatttgatgtgagctgattcatatagttatagaacttatcaattggatagtatgataaattagataaatcatcatatcttgcataggttagatacaatttgtcacagctaactttataacctctttgaattaattcatcttttttacaaataccaaaatatagatagttacctcttggtaaatcattaatattgggaacctgctgtaataagtctaatgaattaaaaaaatcatacatatacataaattttactccttctttgttataagtattaattttgggaaaaatagctacatcaatataataccttactaaatagcaaatatctatatagataattactaaaaggcaatttattatttatacttatttcaaagaggtgatttcaatgaatgaatatggacatataataatgaatatagagcagattttaaaaaataaaggaataagcaaaaataaaatatgcaaagaattggatatacctcgacctaattttaatcgatattgcaaaaattcttttcaaaggatcgatgcaaatcttatttgtaaactatgttattatcttgagtgtaacatagaagaattagttacttatattccgcctcaagaaactaaataaaataaaactacgttatttgaactaaatttcatatatataagtatttaatggaaatggtttagtaagacgtagttttttatctttagtatatcaaataatagcaaaatatttattgatttgattacctgattagatttgattacctgattaagcgtaatatataagtataaacgggagagctaaaaatgattataatttcaaatgatacagtatatttaaaaaaggaattcacacaagaaacatatgatcaagcactgatacgggttgatatgaaggggcttgaatgtgactgtggcagcaatggtaaactagttaaaattggctattatcaaaggtattataaaacatccacgcgaaaaatatgtattcaaattcaacgagtgatgtgtaaacattgcggtagaacacatgcgctttttgtagaatgtatggttccttcgtcaatgttactagtaacaactcaaattgaattgttgcgttcatattataatcatagacttgaagaatttttgttggtatatccaaccattgaacgttctaatgctttttatgtagttaaaaattatgaaaaaaaatggtcgaaaattttgaaattaacaggtctttcgttaatggatgaagaaaagaagataataaaagtatttataaaaaaatatcaaatgcaatttatgcagatgagatcatactcaaaaatagtatctcaattacggctaagtgaaaagcttagctaaatttgatcaatacacataatttttatattttaaagggcctaaatttgttatactaatcctgggataaagagaggggagtgagtataatgaattattttgatataaaaaatatattaagatataaattcttagtgaagtacaaggttatctcggaataagggctttaatgcgctcaaaaacagattcaatatgggataaagtttaaagtgaggagataagtgtattagacactaagttattaaaaatgaatagggaatttagtattgtgatcttaccaaaggatcaaatgatagaaaagaatagtagagataaaaatatatttataatgaaacgactatatgaaatatttttatcgataggtgcaccaaatcatttaaacggatttggttatttagtttcagcaataaaacgttcatgcagtgatattgaaattttgacagaaattacaaaagaattatacccaagtgtagcaagagagtattctacaacttcgtcacgggtggaacaatcaatccgacatataatcaaggttatttggtcaaactgtaatcttgtagagttagaaaaaatgtttggttatcgagctaaacatcgaccttgtaattcagaatttatttcaatggtaactgatcgactgttgtcagaatataaaatatataatgagtaatttataaaaagaagttcatataaaacttctttttatctgctttcaaatgcataacgattttttattttgagtttatctgcaattaaagcaataaattcagaatttgttggttttcctttaagagaatctggggcggccctaataatggtattaatttttcttttgtcaccttgattccaactgttttcaattgcatgacgaattgctttttcaactcttgaggctgtcgtactgtattggcgagcaatatttggataaagtctttttgttatttgacctaataattcgatatcagagtataccattaaaatagcagttcttaaatacatgtagcctttcaagtgagccggaatgccaacctgctttagaattgttgtaatatcatgttcaagtttaacttcactatgatttgtggactgaagattattgactgcttctatccaaatgttattattgtttgataaatgatcaatcagttcagcagatatttcttcatcttcttctaaaatatatatgtagtattgtttcatattattctccttccaaataatgacaaaaactattatataaagacaatgattttagtaaaaggggaattgttattatttattttcttttagtaaactaggtaataagattcatgtttttctaaaatatttcgccttttttagctaatatttaacgaatatttgctaatactcacgaattttggtaaatatttgattataaatggcaatggtaatgttgaagataaaaatttaagattttaacaagttagataaataaactttatgataaatctataattttaattaattttatcttttcatttatcattagatatgatatattgtatacaatgagaggtgttaattatgaaaacaacaacaaatttacaattacatcaccatcattggattgcctagggttttatcagtttattgatacaacccattttgtgttaaatattatttgggtgtatctaatgacaatattactttagcgagtcattagtgtaatgactcgtttttttgtaactaaagggggaaataaaatggaagaatttaagtatttaataccggaagaaagtattgacgcaattattactaatgtatcgaaattacgagagattgaaaatagtttaagagctatctttgcaaagaataactataatgaagtgttaatgccatcatttgagtatgttgacttatatactcaattagattgtggttttgaacaagaaaaaatgtttcagtacattaatcatgaaggtaaaaatgttgcaatgcgctgtgattttacaattccattagcacgtttctattcaacaaacaattatggtgatgaagaagcacgttattgttattttggtaaagtataccgtaaggaaactatgcataaaggacgttccagtgagttttttcaaggtggagttgagttgatcaacaagcctggaattgctggtgataaagaatgtttaaacatgattcaagagtctttaccacatcttggattaaaaaatattcttgtagaaattggttcagcacgtttttttaatcgcctatgcacactggttggtgataaggcagttgaattaacagaaatattgaagtatcgggatataagtgaaatgaaaaagtttgttgccgataatgaatttgatgggcagttaaatgaactattattaaaattgccgactgcttttggtgatatcactttattagatactgcaatcaaaggaataaatgatgaaatattgttaaaggctttggaaagattaaaagagttatataactctttggataataaagaaagtatcatttttgatttaggaatggtgccaacaatgaaatactacactggcttaatgattaaaggatatagtgataaaagtgcgcagccaatcatttctgggggaagatatgatgacttattaccaagattcaataaaaatgttggtgcaattggattttgctaccatatgaatcatattttaaaagcgattgataagcagggggaaggcaataatgattaaaatagcaataactaaaggtagaattgaaaagcaggtctgtaagttgttacaagaagcgggatttgatatggaaccaatttttaataaggatcgggaattattaattgcaacaaaagatggaattgaaatgatttttggtaaagccaatgatgtagtaactttcttagaacacggaattgtcgatattggttttgttggtaaagatacattagacgatgttgattttgaagattattatgaattattggatttaaatataggtaaatgttactttgctgtagcggcttatccagagtatcgtaacaagaaatttgaacggcgtaaaaaaattgcaagtaaatatactaaagtagcaaaaaaatattttgcaacaaaacaagaagatgttgaaatcattaaattagaaggatctgtagaattgggaccaatcgtgggaatcagtgacgcaattgtggatattgtagaaacggggtcgactttaaaagcaaatggcttagaagtaattgaaaaaattagtgatatttcaactagattagtggccaacaaagttagttttaagtttaaaaaagatgaaattatgaatttagttaataaattagaagcagttacggagggaaaataatgttaaaaataattgattatcaaggtaatttagaagcggtagcaactaaattagatagccgtaaagaaagtgttaataaagaagtaaatgaagcagtattaaagattattgatgatattaatttgcgtggtaatgaagctttatttgagtattgtttaaaatttgatggttatcaaattaataatgaaaaagatttaattgttggtgaggctgaaaaagaagaagcattaaaacaaatagatgcagattatctacgtatccttgaaagaactaaagaacaaattactgaattccataaaaatcaaatagataaatcatggtctttatttaaagataatggggtaatcatgggacagatggtgcgtccaattgaacgggtggcattatatgttcctgggggaaccgctagttatccttctacagtattaatgaatgctgttccagcaaagttagcgggagttaaagatttagtaattattacaccggtaaaagaagatggaaaagttaatccgattattattgctgcagcaaaagtaagtggggttgatacaatctataaatttggtggcgctcaaggggtggctgccattgctcatggtactgaaacaataaagaaagccgataaaatcgtaggtcctggaaatattttcgttgcgacggctaaaaaacttagttatggacttgttgatattgatatggttgcaggcccaagtgaggtattggtaattgcagatgagaacgctaatcctaaatatattgctgctgatttaatgagtcaggcagaacacgataaactggctagtgctttattagttacgacaagtcgtgatttagtggctaaagtaaatggtgaattagttcgccaaatggcttatttatcaagaagagatattatcgaagaatccttggttaattatggtggagcaatcattgttgataatttgaatgaagcatttgatgtttccaactatttagcaccagaacatttagaagtattagtagataatcctgtaaatatgttaccaaaaattaaaaatgccggttctattttcttaggagaatattcaccggaaccattaggcgattatatgagtggaactaaccatgtactaccaactggaggaactgctaagttttattcggcattaggggtatatgattttgttaaatattcatcttatagctattatcctaaaaatgtcttaggcgaattcaaggaagatgtaattaaatttgctaaaagtgaaggtttagatgcccatgcaaattcagtagcagtaagatttgaggaggaatagtcatgagaattggaaagattgaacgtgaaacaaaagaaacgaaaattcttgtgcaattagatttagatggagaaggtaaaagtgaaattagtactggaatcggattctttgatcatatgttaacactatttgcttttcatggaggttttgatttaatcgttaaatgcgaaggtgacttagaagttgatactcatcatacagtagaagatcttggaattgctttaggaacttgtttaaaagaagcgcttggcaataaactcgggattaaaagatatggagcttttactattccgatggatgaaacgctagtaacaaccaatttagatattagtgggcgtcctttcttagtttataatgttaatctaacttgtgaaagaattggcacatttgaaacagaaataacggaagaattttttcgggcattggcatttaattcactgattactttacatattaatgaacagtatggaactaataatcatcatattgttgaagctatatttaaaagtttaggaagagctttaaaagaagcggttagtattgatgaagctaacaaagataaagttgtttcatcaaaaggagtcttataaaaatcaaggggggatttagatggtagtaatcattgactacaatattggtaatttaagtagtgttatttccgctttaaaaagggtcggaattgaagctgtaattactcgtgacaaagatattattcgccaagctaaagcaattgtattacctggagtaggggcttttccggtagctatgaataatttaaaaaagtttgatttaattgatgttttaaatgaacgaaaagatgctggaataccaattctgggaatttgtttgggaatgcaaattttatttgaaaaagggtatgaagttgaagaaactaaaggattaggtttcctagatggagaagtagtctttatggatattgatgaaaaggttcctcatatgggttggaatcaattacatttcaaccaaaaccatccaattttaaaaaatattcatgaaaatgatgatgtctattttgttcattcttttatggcaacatgcccaaatgaacaattaattgcttatagtgattatggtaagacaaatataacggcaattgcggctaaagacaatgtgattggttgccagttccatcctgaaaaaagtggagctgtaggacaaaaaatattattagcgtttaaggagatgatcgaatgttagttattccagcaatagatttaaaagatggtcaagccgttagattgtttaaaggtgattataatcaaaaaacagtatatagtaatgaaccagaaaaattagctgagaattttgagaaaatgggtgctaagctgcttcatgttgttgatttagatggtgctaaagatggtgaatgtattaatcttgaaacaattaagaaaataaaacaaaatacttcaatgcaagtagaacttggtggggggattagaaatattgaaacagttgctttatatttagatgaagtaggaatagatcgggtaattttaggaactgctgcaattaatgatccagagtttttaaaaagtgctattaatacctatggtcctgaaaaaattgtcgtaggagttgatgttaaagatggctttgtttcaacttcaggctggttaaaaatcagtaacgtgccatacttggagtttatcaaagagttagagaagttaggggttaaatacattgttgctacagatattagtaaagatggaacattacaaggtcctaactttgatatgtatgaacagatcgctagaacttctactattaactttgttgtttcagggggcattaaagatgctcaaaatattaaagatgtagctagtaagaactattatgcatgtattgttggtaaggcttattatgagggtaaagtagatctcaaggaggttattacatgcttacaaaacggataataccttgtttggatataaaaaatggtaaagttgtaaaaggaattaattttgtagaattgaaagatgttggagatcccattgaattagctaaacgttatgatcagcaatgtgctgatgaagtagtgtttttagatattactgcaagttatgaagaacgtgatattattaaagatattattgaacgcggggctagtgaattaacgattcctctagctgttggcgggggaatccggacgcttgatgattttcgaacgatcttagctagtggagcagataaagtatctgttaattcggcagctattgcaaaccctgatttaataaaagcggctgctgatgaatttggggtacagtgtgtagtcgttgcaatcgatgctaaaaaacgtgatgatgacggttatgatgtttatgtaaaaggtggccgtgaaaatactggaattgatttaatagaatgggtaactaaatgtgaagaattgggtgctggggaaattctattgacttcaatggatgcagatggaaccaaagcgggttatgatattgaaatgatcaatgcggtatgtaatgctgttgatatcccagtaattgcaagtggtggttgtggcagtattcaagatattgtagatgtctttaaaaaaacaaattgtgatgcagctttagtggcttcattatttcattttggcgaagcaactgttgaagatgttcgtaaagaattaaggaaacatgatataaatgtaaggagagcaatgtaatgaaaccagattttacaaaaatggagttgattcctgctattgttcaggactataaaacaaatgaagttttgatgttagcttatgtcaacgaagaagcatatcaaagaatgttagaaacaaatcaaacttgttttttttcaagaagtaggaatgaactatggcataaaggtgaaacatcaggtcattttcaaaatattaaagggatgtatttagattgtgatttagatacactgttaatttttgttgaacaaattggagcagcatgtcacactggagcgtactcttgtttctttaatgaaataatggcttatgataatactaatatttttagaagtctatcaaatctaattgaaaatcggaaacaaaacccagttgaaaaatcatatactaattacttattagatcaaggtgttgataaaatttgtaaaaaagtaggtgaagaagcaagtgaaacgattatcgcggctaaaaatgatgataaggaagaattaatcggtgaaatcagtgatttattttatcatgtttttgttttaatgaataatcaaggggtaacacttgacgatattgaaaataagttaaaagatcgtcataaaataactggaaataagaaagattttcatactaaaggagactattaaaatgcgttccattgactatcatatgcacactagattttcaggtgatagtgaggctgatccgcgtgaacatgtaattcaagcaattaaaatgggactagatgagatttgttttactgatcatcgtgatttcgattacccaattgatgtttttgatctagatgtcgaaggttattatcaaacaattatggctttaaaaaaagaatttgcagataaaattataataaaatggggcattgaaataggtctagatatgaatcatcaattagagattaataatttgattaaccagtatccttttgattttgtaattggctcaattcatgtaattgatcatactgaattttattatggggatttttttaaaaatctaaataaagagcaagctcatcaggctttctttgaagaaacgctaaggtgcgttaaaaattttgactgttttaatgttttaggacatttagattacattatgcgatacgggccttatgaagataaaaaagttgaacataagaaatatcagaatataattgatgaaatatttaaaaatttgattattaaaaataaggggattgaggtaaatacttctggatatgcagttaatcagacttgcggctttccaaattttgaacaagttcaacgttattatgatttaggaggtcgtattattactattggtacagatagtcatacaagtgatcgagttggtcagtatgtcaatgacgttaaagaaaatttaattaaaatcggctttgaggatgttagtacatttacagggcgtttaaaggattagatagcaaaaatctaatctttttaatttattatcataatcattaatcatttatggtataatggataatatatttggaggtaaaaatatggaattatacaacaaggaaacattaaaagcattgaaagaaagtgtcgatgatagtacttattatctgccaaaagctttatttcaaggcagtaaatttggaaatattcgtttagaaacaaaactagcatatgctgctttactagatacattattaagaaagcctgtttttaatcaagaaaatattgctttgttaaaaatagataatccagtaattgctcaaactttggcagcgatggcaaataaagaggtaaatcaggcaaaagtagctaaatacctagatgaactaatagaagctaatttaatcgagattaataaacaagacatttatatttatcatattgattaatgtttaaatttatatctaaaaaaatcattaagaattataatgattataataaccctaaagtaagagaacagtatggcatgctttgttcaatcgtttcgattgcctgcaatattgttttagtgatttttaaacttacaatgggggctattactcatagtattgccattcaggctgacgggttgaataacctttcagatgttggtagtaatttagcttcattatttggttttaaattagctaatcgtcatcctgattcagagcatccttatggtcatggtagaattgaatatgtagctggtctaataatcgcttttttaattttattagttggttttcaagctttaaaagattctatttttaagatcattgctcctgaaaaaataacttttacaatcgtagctgtagttattttaattgtttcaattttaattaaattatggatggcaatgtttaatcgaacggtttctaaaaatattaattctgctaccttaatggctgccagtcaagatagtttaaacgatgtgatggcgacatcagcgactttaatttcattaattttatccctttatactgatttaccagtagatgggataatgggagctgttgtatcaattattgttttaaaagcaggaattgatatctttaaagatactgttgatcctttattggggatggcacctgataaggaattgattaatgaaatcgaagaatatattctttcttatccagaagctttaggaatccatgatttaatgatgcacgattatggaccgggtagaaaatttttaactttgcatgttgaagttgattgtaatgataatattatggcagttcatgatgcgatggacttgattgagcgttcaatgttggagaaatatcatatcctgacaacgattcatatggatccagtagacacaaatgatgctctaacaaatgaattaaaacaagtagtcttaggagttgtcaaaggaattaacaaagaatacagtattcacgattttagaattgttactggaccaacacatacaaatttaatttttgacgttatgattccttcaaatgatgaaattaaacataaagttttaaaagaagaaatcaatacgaaactacgtgcaattaaccctaattactatacggttatgcaaattgaacatagttttatttaaaaaagagccactgcagtttatctgcagcggctctttatgctctaaagattacctcttctttttcatacatcattttagctgcaatcattgaaacaattacataaacgattgaccagccaattgtcatatatagatgaacataatttaattgattgaatataatttctttaataacgattacaacattgagaattgggatattcatcatcgccattgaaactgaacttggctccatatacattgtaattactgaaagtaacaccggaataagggttacaggagttaaatacgtattagcttcttttaaagaacgagcatatgttgaaactaataacatcactgcagaaataaagattacatataatactgctaataatacgattaacagcatgctttgaagtgataaatcgatagtgatggccatcgtatcactcattccaaatttaaaagcaagcagtaaaccgactgctgataaaattgaagtaatgctaccaaaagttgcagtgacaatcagtttaccaattaaaatagaacttctagaaatacttgttgaaagtaatggttctaaagttccccgttctttttcaccagcacctaaatcggttgcaataggtacgattcctgaaccagaataaccaatgatcatcataggaattaacattcctagcatcattaaggacatactatcagcttcttcgtctttagcatgttcattataagtaaatggttgtaaaactttacttgataaatgatttgcttctaaatatgatgctaaataactattttgataagtactgaacattgtttgaacagtacttatagcagtcattgcacgttgcgaggttgtatcataatataggtcaacttcaggtgtacttccttgtgttaatgattcattaatatcattagcgatgatgtaagctacgattttcccatcataagcttcgttaatagggtctttgctattaacaagttcgtaaatacccgcttctttaaaaagagcagtgatttccggattatttgtttctaaaacaattttatatttattatcttcgcttggtgatgccatatcaccaattgatgaaaagataaaggtaaacaataggggcatgactatgattgggataacgaaagtcattagtaatgttttacgatcacgtaaaatatctttaaattctttttttacaattgtcataatattattcatgatcattacctccaatacattcaataaataaatcctcaagattatcttgttgatattccttttttaattgttcaatcgtgccgctggcaacaatttttcctttatgaattatgataacgcgatcacatagtttttcagtttcatacatattatgactagaaaaaacaatagctttattttcttgcttacattttaagataaagtcatgaattaatttacttgataaaacatctaatcctgtagttggttcatcaaataacataacatcaggatgatgaatgatacttcttgctaatgatactttctgtttcatcccccgactatacttaccaacaggacgatcaatatattctaccatttctaaatcttgagcaatttgatcaactgcttgtttagcttcttgatcactcatcccgtttagtttagcaaaatatgtcatattttctcgtcctgataaacgatcatataaagcaacatcaccaccaaataaaataccgatatgttctctaattttactaggattatcaataatattataattatcaatataagcgttaccgctagttggctttaacattgttgctaccattcttaatgttgttgttttaccggctccattttctcctaatagaccgataatttctccagcgttgacttcgaaagatacattttcaacagcattaatttttttaaatgtctttgttaagttttctacttttaacatgttcttcccctccattaattatcatcatcttgatgataatggttataaattactttgattacataggtgataaagataatgatgtaaaaggaagtgaaaattagttcacagcctaatacggataattgattgtctatgattaaaggttttccattgataattaaaaatagatataaaccaaaaaaaccaaatccataaagaccaaaaaatataaataataaacgataccgggcctttgttagaggatatatttcatagtagatcattaaaataaaacaataagtaatactaatgaacaaagcaattaaatattcccaatcaccaatcattaggtcaatattaaatatctctttaataaaaaatattgcaataataataaaactcaatactgaaaaactcttaaaatagatatttcctctaattttcaattgtcgttcatcgagtcggcatttaaataatgacttaaatttcttcatcaagaatatcctcccaaaataattcatccaacgatttatttaaaactttacaaattttaatacaaagtttaactgttggattataatctcctttttcaatcgcattcattgtttgacgtgataccccaacagcatctgctaaatctttttgggtcatatccagtgcagctcgagctgcttttatccttagatttttagacatctcatcacctcaagataatagtagtgtatattttaataaatgtcaaatatatattacattttgtaattaatatttatgattataatataaatataaacatcctcggattataatgataatgaaaatacaagctacgattccaagcaataagtcaaaactgtagagtggggcaatcacagaaaccaatgccattgtaataatctcaaaggtaaaagaaaaatttcccccaaccttgtcagcaataaataatttacgttcatcatgatcatttatatatttttcaattaactttacttcatttttagctaaaaagaagttagaaattagattaatgcacggaaaaacaaataaagcaaaagaaagtcctgtttgatatccatgtacaaagtcaatgtaatgttcgttatttgaattaatagttaaaacattagttaaggacaagatgattaaagttaaagcagatatcattaaagtaatcatccagtaattagtttttttcaagtcttcacgtgctagaacaattcttttatccattatttagttcctcctcaaaatcaaatatttcttcaattgtcaagttaaaatattttgcaattttataagctaaaattaatgaagctgtgtatttgcctacttcaattgaagtaattgtctgtcgggttaccccgacagaccttgctagttcttcttgagaaattttataggcttttctaagttcaggaattttagttttcattataacactcctatctttgcaaagtatactttacaattaaagtatagtttgctttgcaatatatgtcaagctaactttgcaaaataaaaacctgctaaagattaaaattctttaacaggatatttttcagcattttttataagttttttttcaataattgtacttacatcaagatttagtgagtatgccagttgaaaacaatatatcattacatcggcaagttcttcactaatattttctgttttgtaatcattatcccactgaatacattcaagtaattccccagcttcaatagaaatacttttaattagacattcgggatgttctaattgatcccaaccacgtttttgaacaaattcaataattttattttcaagctctttcataaacatctccttttttataattatatgaactattgatagataatcaagtaaaatgaataaatgtcgatacaaacgggaataaatttagatataaaaaagacaggaaaataatgcatagtaaaaaagtaggaaataattaaaaaatactcttgacttttaaaatagatttagttaatatattgccaacgacaatgaaaagaagagtagttcacttgaactttatagagaatccttggatggtggaaaaggataggggataatgaatgaagatggtcttggagtcttgtaggcgatatttagcctatgacgggtgtgcccgttagcgcactagagtatgattgtactcgaagaggttattgctgtgaggtaataatgaattaaggtggtaacacgggcaatgctcgtcctttggcttaaaggacgagtttttatattttaaggaggattttatgattgaaattaagcgcgttagtaaagtttatcgattaaaggatcgtgaagtagttgctgtagatgatgtttctttaactatcgaagatggcgatatttatggaataattggttatagcggagctggtaaatctacattagtgcgtctaattaaccaattagaggtacaagatagtggtaaaatatttattgatggacaagatttagggaatttatcacaaatagaattaagaaaattgagaactaaagtaggaatgatttttcagcattttaatttattgtggtcacgaacagtaagtgaaaatattgaattagctttagaaattgctggtaataaagataaaaggattcgtcagcaaaaggttcaagaactagtagagctagttggtttaacaggtcgtgagaatgcttatcctagcgaattatcaggtggacaaaagcaacgggtggggatcgcgcgagctcttgctaatgatcctagaatcttattatgcgatgaggctactagtgcattagatcccgatacgacaaaatcgattttagaattattattaaaaataaataagaaattaaatattacgatcattatgatcacacatcaaatggaagtagtccaaagaatctgtaatcatattgcagttatgtcagaaggaaaagttatcgaagaaggaactgttaaagagatttttacttcgccgcaacattcagtaactaaaagttttattcaagaaggaaaaaatcataatgaatttgatgagactgttctaaagaaaatttattctaaaggacgattattgaaagtagtgtttgatgaaaatgttagtcgtttgccaattttgactaaagtaattagagaatgtgatagtgatataaatgtaattgaagctaatttaagcaatactatcgatagttcatttgggattatgattttgcaagtaatcggtgattatgaaaaagtaataactttatttgaaaaatatttagctaaagtggaggtgatgtagatgcgaagtattttagaaaacattgatatcaatgcgatgatagcagctctaaatgaaacgctctttatgacattgatttcattgatttttgcggtaattcttggaatggtcttgggaattgctatatatttaactcaagatgatggactgtatcctaatttgatcgttaataaaattttaaatttgatcgttaatgtatttagagcggtaccatatattattttagtatttttgctaattccattgactacatttttggttggttcaatgttaggtgctaaggcagcattaccgtcattgattttatcaagtgcaccattttatggacggatggtcatgattgctttaaatgaagttgatggtggaacgattgaagcaagtaaagcaatgggggcaagtaatgttcaaatcattactaaggttttaattccagaagctaaaccagctttgatttcttcgattacagttatgtccatttcattagttggttatacagcaatggcaggtgccataggagctggtggtcttgggaatctggcatatctatatgggtttgtaagaactaacaattatgtaatgtatacagccacatttttaattttagttattgtttttattattcaatttattggtgattattttgtaaggaaaatagataaaaggtagggaaatattatgaaaaaattatttatcggaattattagtttattattagcagttacactaactgcatgtggtggaaaaacagaacgtgatgataaaacattattagtggctgcaacctcaaagccacatggtgatattttggaagaagctaagaacattttaaaggatgattatgatattgatctagagataaaaattttagatgactattatatttttaatcgctctttaaatgatggtgatgtagatgcaaactttttccaacatgtcccattttttgaaaaggatattaaggataataaatatgatctagttaatgctggtggagtgcatattgaaccatttggtttttattcaaaacaaattaaaaatattaatgaattaaagaaaaatgatattgttgttatttctaattctgttgctgatcatggacgaattctagctattttagatgaagcagggatcattgaattagatgataaagtgaaagtgcaagatgcaacgattgaagatattaagactaatcgattaaatttggaattcaaggaaattaaaccagaattgctaactaatgcgtataaaaatgatgaaggtgcattaatcgcaatcaatgggaattatgcaattgatgctggcttgaatccaactaaagatgcgattcttttagaatcagcagatgaaagtaatccatatgttaatatcgtggcgtgtcaaaagggacatgaaaatgataaaaaaatcaaagctttagtagcagtattacaatctcaaaaaattaaagattttattaccaatacgtatagtgatggatcagtgattccggttaaataaagatgcttaggcatctttttttattatggcgattgcgtagatacagaaaataacatataatttttaaagttaggaggttttaccaatgttatgtagagattatttgtatcaagaagtagaggttctcattgatcgtccattaggttctcagcatcctcaatacggcttcatatatcctcttaattatggtttcattgaaaacacagttagcggagatggagaagaacttgatgcttatttgcttggtgtctttgagccggtagaaagatatcgtggggtagttattgcagttatccagcggactaatgataatgatgataaattgattgttgttcctcataatgttgattatagtgatgaacagattagagccttaacagagtttcaagagagatatttcaattcagttattctaagataaaggagaagatgatgactataacagtagacgaatatattaatagtttttaccaacagatacaaataaatttaattaagttaagaaaaataattaaagaaacggcgcctgaagctcaagaaaaaatatcatggggtgtaccaacatattttcaagacggttttctagtccagtttgcagcatataaaaaacatattggcttctatacatcaccgcaaacaatagaagcttttaaaacagaattagctaattataagacaaataataaaaatacagtgcaatttatgtttgaacaagaattaccagtagaattaataaaaaagatggttttatttaaaatagaggagaacactaaatgaggctaggaacaacatatattagtgtcaatgattttgctaagtcactggctttttattagcttttattggagcaagagccattatattgtaatgatgatcggtgggctacatttgattgtgggaattcattatcattatataatcgacaatttgatattgattttcttgtaaataacgattatcgtggccattataatcattcatatttgacaactttgaaaaatgaaaatagtgataaaataaatacatcagttatattcaattttgaagtagaggatttaataagtgaatatgaacgaattaaaaaattaaagataggggctgtatctgaactgttatttgtcaatatccatatgccatactggtattttacaatcaaagatccagatggtaatgaaattgaaattactggcaattataatggaagcgacaagctaacagatgagtaaatttttatcttttcatattcagtaaataaaaaataattatattaaaatatgataggataaaacagttggaggttttaataatgaaacgtaaatttttcttttttgatattgatggtactttggcagttgggacaccaggaaatcaatatgtaccagaatcgactaaaatagctatttcaaaattaaaagaggctggtcattttgttgctattgctactggaaggagttatgcgatggcagtagaacatatgaaagaactagggtttgaaaatatggtaagtgacggtggaaatggaattacaatacataataaattagtagaaattaaacccttagattacgataaatgtatcaatttaattaatgaatgtaaggaaaaaggatatatttgggcaatttcacctgataatgcgacaagacgattggcaccagataatcgcttttatgattttacacatgatatctatatggataccatagttcaagaaggtttggatccaaaagactttgataaaatttataaagtatatgtggcttgttatgctccagaggaagaaaagctggaaactttaaaggaactgccttggtgtcgttttcatcaagaatacttgtttgtagaacctggcgataagtcagttggaatcaaaatgatggttgatcattttgatggggattatagtgatgtagttgtttttggtgatgaaaaaaatgatttgagtatgtttactgatgaatggactagtatcgcaatgggaaatgcaattgatgctttgaaagctaaagctgcatatattacagatgattgtgacaaagacggtatttataatgcctgtaaacattttggctggatcgactaatatgtccgttaatcgactatttgaaactatttattatctgatcgaacataagcagactactgctaaagaattggctgaacactttgaagtttcaacccggacaatatatcgtgatttagatcgcttgatcgtagctggatttccaatttatgccaatcaaggagctaagggtggaatttatatagatagtgaatttgttttggataaaatgacattcagtgatgatgaacagaatcaaattttaatggcacttcaatgtatagagaggcttcaagatagagatgaagcaggcttaattgataagatggcagcgttatttaataaaaataaactagattggattgaagttgattttactacttggcatcataacaatagtcaaaatgaaaagtttgaaacaataaaaaaagctatttttgaacaaaaggaaattaaatttaaatatattaattcttatggtgagaaatcacagcgatgtgtttttccaaataaactgttttttaaagcaaatacttggtatttacaaggatattgtcttcaaaaaaatagctatcgtgtttttcggctaacaagaattatagaattactaacgacatcaaattattttcaacttgaagaaattgctttaccaccaaaaataaataaaattcctaatttgaataccccgaggattaaagtgattttaaaatttgataaaagtatagggagtgttgtttttgatgaattcggtgatggtgtaatctgtgaggatactgctggaaattatatagtaagtagtgttgtccctgatgattactggttgattagttttattctctcatttgggtctaaagttgaggtaatagaacctcaagaccttaaagataaggtaattatagaaattaataaaattaaggctgtttataaacaaacttgacagaggatgtcaagtttgttttgttataatgattctatagaaaggatgagttaaatggaaataatcacagtcgatcaaaataatttggagaaggagcatatttgttgtgcaatttctagtaataatgatatccaagttaaagctaaaaaagcttggcttgaggaacagtttaaatgcggattgatttttaaaaagatggatgtaaggggaaagtgttttattgaatatttaccacttgaagaagcttgggtacctatcgtaggtgatgatcttatgcatattaattgtctttgggtatctggaaaatatcaaggacagggattagctaaaaaattgttggaagcttgtattgaagattgtcgtaaacagaagaaacatggaataactgttatttctgcaaaaaggaaaatgccgtttgtaatggattataaatttttaattaagcatggttttatttcaataatgagtctagataaatatgaattaatgtatttaagtttagattctcaagcagttcaaccaagttttacgattaaagaaatgacttgtgaggaaggtggattagttttatattatagtcatcagtgtccttttacagctaaatatgccccgatgattgaagcgtattgtcaagaaaaaggtttaataattaaattaaaactattaaatagtagtgaggaagcaaaaaatgcgggaattctttttaccacatatagtttgttttataatcataaatttattacaagagaaattttatcggttaaaaaatttgagaaaatattggaggaattaatatgactaaattagattataagaaagaatataaagatttatatttaccaaaaaggtccccaatgttgattaatgtagataaaatcacgtatgtaacagttgatggtaaaggtaatcctaatacatcagctgaatataaagaggctctagaattattatatagtatttcttttacaattaaaatgtccaaaatgacggataataaaatagatggctattttgaatatgtagttccccctttggaaggcttatggtggctggataaaaaaccaactgaaaaagtaatcggtgataaaagtaaattttattggaaatcaatgattagattacctgaatttgttacacttgaagtttttgaacatgctaaagaattattaaaagtaaaaaaaccatacttaaatcttgataaagtaaattacgaaattattgaagaagggaaatgtgttcaaattatgcatctaggcagttatgatgaagaaaatacgagtattgaaaaaatatatcaatttatcgaaactcatggattacaaattgatctcaatgaagtccgccgacatcatgaaatttatttaagtgatccaagaaaatgtaaacctgaaaatttaaaaacagtaatacgttatcctgttaaataaaaatacgttatcataatagagggtttgtagtataattatgataaatagaaaggcgggatataaatgcaacgaacattagaagaaattactcagtatattgatcatacattattaaagccatatgcgtcaaaagaagcgatgcaagctttttgtaatgaggcaaaagaattaaaggtaaagatggtcgcaataaattcttactatactaaattttgtaaagaattattaaaagacaccacaatccatgttggcgcagctatttcttttcctttaggtcaaacaacaatagcagtcaaagcttttgaaactattgaggcaatcaaagatggtgctgacgagattgattatgttttaaatcttgctaaagttaaagacggtgattttacttatatcaaggaagagatggaaacaattgttaagatttgccgtgaggcaggaatcattagtaaagtaatttttgaaaattgttatttaacaaaagatgaaatcaggaaatgtgcacaaattgctaaagaagttaaaccggattttatcaagacttctactggctttggaccaggtggagctttgatcgaagatgtgaaaataatgttagaaactgtagatggtgtttgtaaagtcaaagcagcaggcgggattagggattataaaacttttaatgaatttataaatttgggagttgaacgaattgggacaagttcgactaaaacaattattaaagaatttaaggaaaatgatgagtaatctaggtcactagattactttttttgcatataataacttaggtgataatatggaagagtatcaaaaaacggtaatgcgtgtttcaacagttacattattaggaaatttaattttagcattttttaaaatcttaattgggtttatatctttttctaatgcaattatttccgatggtatccatactgcgtcagatgttttaagtacagttgtagttatggttggcgtaaaattatccagtaaagaaagtgatttagaacatccatatggtcatgaacggtttgaatgtgtggcagcaattattcttgcagttatgttgtttttaacggcgttgttgataggatatagcggtattatagaaattattaacccaagtaatgttaaattaaaatatggatcgttagctattgttatagctgtaatatcgattgtggctaaggaagcgatgtattggtatacgattattgaagcaaaacgtatcaattcaaatgcaatgaaagcagatgcctggcatcatcgaagtgatgctttttcttcaattggcagtttagtcggcgttattggtttttatttaggatattatattttagatgcaattgctagtattctcatttgtggttttattctaaaggtagcgatcgagatttttaatgatgcgattgatcaaatgattgatcatgcctgtagtagagaatttcaagaggatttgatttctttaattacggagcaaagtgaaataattaatattgatgatttgaaaacaagattatttggtaataaagtatatgtagatttagaagtacaggttgatggaaatgataatttacgtcatgctcatgctattgctcatcaagtgcatgatttgattgaaaataattttccaacagtcaaacattgtaatgttcatgttaatcctagtgacagttgacaaagagtttacatcttctaaggcaagtgctaaactatagtagttgtaaataatagggggtaaaacatgaaaattgcagtatataattatcgagaatttgatgagggacaatattttgaaaagttttcacaacattattgtgttgaaataattaaaatatatgattcaccaaataaagaaaatgcagttttagcaaaaggttgtaacggggtaagtgttattactacagcaatcactaaggaaattattgagatttggcatgaacaaggtgtaaaacatatttcaacaagaactattggttatgatcatattgacttgaaagcagctaaggcgaataagatgatcgtaagtaatgtaacctattcgactgccagcgttgcaaattatacagtaatgataatgttaatggctttaagaaaaatgaaaatgatcatgcgtcgagcaattggatttgattattcattaaacgggagtattggattagaacttgaaaatatggttgttggggtgataggaacaggtgctataggtcaaaaagtgattaaaaatctaagtggttttggctgtcagatacttgcttatgacccatttgaaaaagaagaagtaagaaaatatgcagattatgtggcaatggaagaaattattactaagagcgatatcataacatttcatgttccggctttagaagatacgtatcatcttgtttgtcaagaaactattgaaaaaatgaaggatggtgtcattataattaataccgctcgtggaagtattatcgataccagtgatttgattagtgcgttagagagcggtaaaatcgctgcctgtgctttagatgtaatcgaaaatgaattaggattatattataatgattataaatacaaagtgattggaaaccatgaattatctatattacgagatatgcccaatgttttattaactccacatatggccttttatacagaacaagcagtcagtgatatggttgaacattcgattgaaagtattgtagctgatcgtgatggtaaagaaaataaatttagagtatgttaagatagttttatagttataaattttagataaatattattttcaataatgttataagcttaaaaatatttagctacatacattttaacaataagtagttagaaagttatgaataagttagaaatgtagtattaatttatttattggagacaaactattatggggtgataatagtgaagaataagaaaaaacaaaataagtcaaatgaagcagtaaaaacagctggtaataatcaatggacaaataataataccaaatattatcctgatgaacgcgagcgtcaagatggtcccggaggcaattaataaaaacaagttggttaacatatgttaattcaacttgttttttatagatttacttataagaaaggaatataataaaaaaagtagaaagctctacttttaaatgcatggctagggtacttggattcgaaccaaggaaatgtcagattcagagtctgatgccttaccgcttggctataccctaattagtggacatttataattttaaaactttattggaaaaaatacaaggggatggaatgaaatttatgaaaattagaacaagatttgcacctagtccaactggttatatgcacataggtaacttacgaacagctttgtatggttatttgattgctaaaaaagacgatggtgattttattttgaggattgaagatacagatcaagcccgggaagtagctggggcaatagatgtaatttatcaaacattatcagatactggacttgaatatgatgaaggacctgataaagatggcggatatggaccatatattcaatcacaaagattagaaatttaccaaaagtacgctcatgagcttgttaagctgaatggagctcactactgtttttgtaatcaagaaaatgttaagggtaataaagaggatcaaatatttaaagatccatgtcatcaattatctgatgaagaaatagagaaactattgtcagaaaataaaccgtatgttatcagacaaacaattaagcaggggcaaacaacttttaatgatgaagtatacggagaaataactgtcgataatgatactttagatgagggggtgttactaaagagtgatggttatccaacatacaattttgctaatatcatcgatgatcatttgatgagtataacccatgtagtacgaggaaatgaatatttagctagtacgccgaaatataatataatttatcaaacttttaattgggaaattccaacgtacattcatgtcccgccagtgatgaaagatgagcagcataagctatcaaagcgcaatggagatgcttcatatcaagatttaattaagcaaggatacctaaatgaagcagtcattaattatattgctttattagggtgggctccagaaggtgaggaagagattttttctttatccgaactgattaaaaattttgatattaaaagaatatcaaaggcaccagcaatttttgatctcgataaattaaagtggatgaatggactttatttacgaaatttaacgttagaaaattttcatcaactagcaatgccgtattatcaaaaaataattacacgcgatgttgatttattagaactgagtcaagtactacaattgaggatttcctatttaaatgaaataccggagatgattgattttattaatgaaccatgtaatgctgatgaaacattatttaaaaataaaaagatgaaaacaaatcctgaaaactcattagaagctcttatttgggttagagatgctttaagtacttttgataattttaatgatgatctagcgttacatgatttgtttattaatttagctcaagaaaaagaagtgaagaatggacggattatgtatcctgtcagagttgctttgacttttaagtcatttactccgggcggagctgttgaaattgcacatattttagggaaaaatgaatcacttaaaagaatcgatctggccattaagttattaagtatgaaataatttgatacttaaattgaaatagtattttgaatatacataaaagccttttttacaggaattttgtttctattaaaaaggcttttaaaagtggcatatattactgttttattagctctgattgctttaaagttggtacttattattataatgaatataagttttataattattgatgttgatatttctgggtccatgtctaaaatatactcaactgtatagataattttgccatagattcactacactatctaaaacatctaataattatattgataaaaattgttttgaataatgattgtcttttttttataaatagtgctataatatttacatggtctgttggtgaagcggtcaacacactaggttctcatcctagcattcacgggttcgaaccccgtacaggctaccaaataaaaataacacccacgtaaggggtgttttttttgtttggttttgaattgatgagtttattgaggaaattcatcttcatcaataaactcataacccgagtgacggtcatcaacagctttagcaatttgaattttataatcaagatttttttgataatcaaatgaaaaaattcctgcataaagagtatccagtaagtatttaatcgatgttgttgttgcaaaatctccaatctttgtatgtaacatttcacgtgatgaaattcgtaatgttacatcagcaattttagaaaggcgattatttgcaatacaggtaatcgcgatgattggagtttctttctttttcaatactttagcaacctcaataataaattctgtttctccagaatatgaaattaaaatagcacaatgggtttcatcactcattgccgcttgaaccttgggattgccaggcagacgacagatatttacattacgatgaatataaaataatttacttctaaatccttctgctaataaaaggttattagaaactccatagagatctaattctttagcatttcgaagataacgtaaggccgtttgtaagtcatcatgattcagcatggacatcgtgtcttgaatcgcatcaatttgaagttgaccgatattattagaaattgtcataatatcatcactaacaacaaaaggaatactagcatcgaccttttgttctttaaataaatattcgagttctgcaataaaatcttctttaaaggcgttccagccggaataacctaattttttggcaatacgtactaaaagtggggcagaagtgaatgttgctttagcaatactgttggctgacatattctttatttttaaaccttgttcaagaatgtagtcaataataatagcttcacttgatgaaaagtgagtatgttcaagtttgtgaattattaacatattttttacctcgctttatttcattatacgtgtcgaagacaaaagagtaaaccaaaaagaattaaaatgataacgttttcatttcaaatgtggtagaatataagtatgcagctaatgatgaggaaatttctgagtcaaagggtgaacaattatttttgttttgttcaaccattagtacgccctaatggtttttagtttaaggaggtaaaatggaaagtagaattgcaattttaggaatttttgtttatgaattagacagtgctaataagattaatgacttgttgcataaatatagtcgctatattattgggcgaatgggaattccctataaagataagcaagtatcagttatgtctgttatcgttgatggaccaaatgatgtaataggggctttatcgggaaaaatcggaatgctcaaaggtgtcagtgtaaaggcactatattcaaaaggatagaatgagtaatattgatttaattaacaagcttcatcaagaaggcgcattggattttgatgagtttaaaagattattaaaaacatttgatcaaaacgattttgattacgctaagaagattgctgcgaaaatcactgaacaaatatttaaaaataagatctatattcggggattaattgaaatcagcagttattgtaaaaatgattgttattattgtggattacgtcgcagtaataaattagcattacgctatcggctaaatttagaagaaatattattatgctgcaaagaaggttatcgcttaggctttcgaacatttgttttacaaggtggagaagacgaatattaccaagatgaacgaatggtagaaattattgagaaaataaaagaattatatcctgattgtgcaattacgctatcgttaggagaaaaaagtaaagaaacttatcaaaagtattttaatgcaggtgctgatcgttatttgcttcgtcatgaaacttataatagagagcattactatcaacttcatcctcatgagatgtcatttgataatcgaattgactgtcttttgaatttaaaagcaattgggtttcaaacaggatgtggatttatggtaggaagttatcatcaggatattgattgtctggttaatgatttattgtttattaaagagctaaagccggaaatggtagggattggaccatatttagtgcatcaaaatacgccttttaaaaaccaaccaaatggtgatttaaaacttactctttttttattaagtttgattagaattatgacaaaggatgttctattgcctgcaacaactgctttagcaactttagattctaatgggcgcttagagggaattaaccatggttgtaatgttgtgatgcctaatttatcacctcaggaggtaagaaaaaaatactcgttatatgatggaaaagcagcgagtggacaagaagcgagtgaaggattaaaagaattaattgatacgctaaagacggcgggatatgaagttgtatatgagcgtggagattattgtaaatttgattacgagggttagacctaagtaaaagaaagtgagaaaaaggaaaatgtataatgtaaaatctaataaggctgaagaatttattgatgatcaagaaatactggaaacaattgcatatgctaaagaaaataaagataatcgagaattaatcttttctttaattgagcgtgctaaagactgtaaaggattaacgcaccgtgaagcaatgctgttattggagtgtgaaattcctgaagcaattgatgaaatggaaaaagttgctaaaatgattaagcaaaaattatatggtaatagaattgtaatgtttgcacctttatacttatcaaattattgcgttaatggttgtgtctattgtccttatcatttaaaaaataagcatattgcaagaaaaaaattaactcaagaagaaataaaaaaagaagtcatcgcacttcaaaatatggggcataagcgtttagcattagaaacaggagaggatccaatcaataatccaattgaatatgtattggaaagcattaaaactatatatgggatcaaacatataaatggagcaattaggcgggttaatgttaatattgctgcaacaacagttgaaaactataaaaagctaaaagaggctgggataggaacttatattcttttccaagaaacatataataagaaaaattatgaagcactgcatccaacgggaccaaaacatgattatgcttatcatactgaagcaatggatcgggctatggatggtggaattgatgatgtcggtattggggttttatttgggctagaaatgtatcgatatgattttgtgggtttattgatgcatgccgaacatttagaggccgcaaaaggagttggaccacatacgattagtgttccgagaatttgtccagcagatgatattgataaatcagactttagtaatgctatcagcgataaaatttttgaaaagattgtaatgatcatcagaatggcagtaccatatacgggaatgattatttcaacacgtgaatctaaacgggttcgagaaagagtgttagagttaggtatttcacaaattagtggtggctctaagacaagtgttggcggttatgatgaacctgaaactgaagaagatactacttctgcacaatttgatattagtgataatagaactttagatgaggttgttaagtggttatgtgaattaaattatattccaagtttttgtactgcttgttatcgcgaaggaagaacgggagatcgttttatgcaattatgtaaatctggtcaaatctcgaattgttgtcatcctaatgctttgatgacattaaaggaatatagtcaagattatgccggtgatgatactaagttaaaagctgataatttaattatgaaggaattagataatatcactagtgataaagttagaaaaatttgtcaagaacgtcttacgatgattgaagacgggaaacgtgatttcaggttctaataatggcagggttaaataaaacaccaggagctaatcggctccatattggtttttttggaaaacgtaatagtggcaaatcggcattgatcaacacctttgttaatcaagaagtttcaattgtctcaagtgaaccgggaacaactactgatcctgtctataaggcgatggaaattgatggtttgggaccatgcttgttagttgatactgcaggttttgatgatattgggactctagggcaattgcgaaacgataagacaaaaaaagctagtgaaaagattgatattgcaatcattctttttaatgatagaaagatttgtcaagaattagactggtatcattattttaaagagaagcatattcctacgatattagtaataagtaaagctgatttacaaaggaatgataatcttctaaagaaaattactgaagcaactagtgaaacaccattactgattagttcgttaacgaagcaaggaataaaagagttacaggaaaaattgcttgaaaaggtaccggctgattttgaaaaagaaagcattacaggtgaattagcaaaaaaaggtgatcttatactattagtaatgccacaagatattcaagctcccaaaggcagattaattttaccccaagttcaggtaatgcgtgaattgcttgataaaggttgtcaaattatggctgtaacaacggaacaactaaaatcagctttacaaaaattaaatcaagcccctgatcttgttattacagattcacaagtatttaaatatgtttatgaaaatatttcttcagaaagcaaattgacatcattttctgttttaatggcaggttataagggagatttaaattattatgctaaaagtgttgaaatcttagaacggctgaatggtgattcgacagttttaattgcagaatgttgtagtcatgcaccattaagtgaagatattggacgggttaaaattcctcgaatgttaaagaaaaaatttcctggaattggtgttgaaattgttagtggaacagattttccagatgatttaaccaagtacgatttaattattacttgtggtggctgtatgtttaatcgccggtatattatgacaagagttaatcaggcaaaagggcaaatgattccgatgacaaattatggcatttttattgcatatgtaaatgggatcttggataaagtcatatattaaaaggactattcaaatgatacagaagtaaaataaaggtagatattggaactaatatctaccttttcattacatttgcatcatggagtatctttttaattactcaaatgtttcagcgacttcttttaaatatttaataattggcagatgctgcggacaaatatgttcgcattgttgacatccaatacaagtagatgccttgccattagtttttgtgtgaactccataataataatcactattccagtcattaaatatttttttatcattataacagccaaataagtcaggaattgaaattttcatcgggcagccgtctgtacaataacgacaagcggtacaaggaattcctcctaaggaatctaatatttttcgaacttttgctaccgcctcgtattcctcatcgttaaaaggaatgaaatttttcataaccttcaaattatctttcatttgctctaaattactaacacctgataaaactttatatacaccttcaaaagacgctgcaaagcgtagagcataactagcgttgctggcatttttatttagatcagttaaaattctatttgctgcttcgggaagattcgcaagaccaccgcctttaattggttccattactaaaataggtttattaaatttgcgacatacttcataaaccttcttactttcaacactaggattattaaaatcagcataattaaattgaatttggacaatttctatttcgggatgttcacttaagatcatctctaaaatatttgcagtatcatgaaatgaaattccaatgtgtttgacttttcctgttgcttttaattcttgagcagcttgataagcttgacatttttgaaaatgcttataattttcacggtcttgtgcatgcattaaataataatcaaaatatgaaacacctgttttttgtaattgctcattaaatagtggaagaatatcttctttgctgttaaaaaaacttttagttagtttgttagtaaggacatatgattcacggggatagcgtgagactaaacaatcacgaagtgcggtctcactttttccgcctagatacccgtgggcagtatcaaaataattaaatccttcctgcatatacaaatcaatcatttgattaaactcgtcataatcgacttcatcatttttcattggtagtcgcatacaaccaaaaccaaatttattttccataattaaccttctttctattatagttgtattaataaatttatcatacatcttagagttaactagaagtcaatatttgaataaataaaaatagttttaacaaagaataatttttgattctatttaaaatagctaatatttttagaatcaaagcgatcaatcagtggctttgtttcattactgtaaccaacagctacaacaccaacgggatattcattatcagctagattgtaatagtttttaaaaccttcaactctttccgaaactggagcgattccacaccagcagcaaccaagcccttgattgactgcttcaattaaaaggttttcaattgctgcactacaattgattagaccatattcaggtgaaatagctttatttaaatcagctattacgagaatagcacaaggagcttctttcatcattgttgtatatggtgataatttcgtcatatcatttagtgcttgagaatttgtaataactttaaatttccattcttgtgtattacgggctgtcggcgcgttcattgctgcttttaaaagttctaagattttttcaggttcaactggtttgttcaaatactttctaatgctttgacgttgttcaatttcttttaacatttttattacctcgtttctagtatgattataacgcagaatttataaatacttaagataatattactgtaaattatttatatatttatgctatagtaggactagaggtgaagtgaatgttggaggcacagcatataaaaataaaagtagtaggagaatatcgctgtattgtaatcagtgatattcactctcacttagatcgatttaaagcactgctaaaaaaggttgattatcgatacgatgattacttgattattttaggtgactttattgaaaaaggtacgcaagctttagaaactgttagatttttacaagaacttcaggcaaaaagtgagcgcgtatatgtgattcttggtaattgtgaatatgcgttagaagaaatggtagataatcctaaatatgctaaccaaatagttcactatttaaatcgtattggtaaaggcggaatgattcgacaagctctagaaaaattgaatatagacataaaaaaagaaaatcctgaagtaatgcaggtaaaaataaaacagtttttgcggccatattttcaatattttaaaactttaccaacaatactagaattcaataattttatttttgttcatgcaggaattgaaaatcgaaaagactggcaaaattcatctacttcatcgcttattgaaatgcgaacgttttatcaaactggtcactgtttagataaatatgttgtggttggacatttaccgacatcaaatcaatatgctaatgcaatcaataatgatattatcattgataagcaaaagcgtattattagtattgatgggggaactggggtaaaatctattagtcaattaaatgcattgataattactggtgatggcgatagatttaagttatcaaaagaatatatacagccgttaccgttatatcaggcagtagttgatgttaatgtagaaaaacaagttgtcaataaagtggcatggcctaattttgaagtcgaggtgcttaagcagggaaaattattttcaacctgcaaacaaattaaaacaggtaagatttttaagatcaagaatgaatttttgtatttaaataatcaaaaatattattgtttggatgactatgttgattatttgattcctttggaaaaaggtgaggtaattaaattagtgggaatatacggtccttatgcttatgtgatcaaagataacgaaataggatgggttaaatatcgttatttaaaaaaagtaaattagatatctgaggataattgggtatctttttttatacagcgggaataattttcattattataataaaaaaatgtaaatgtgtaggctaaatataagatttttgttataatagaaacgttgcgaagcaaatgaactgtttttatttataaacaattagttttgcaacccgacgggactaaaacgaacacggtgttgttcaagattaggagggttttatgtcaaattcgaagaaaatcgtttggtataacttagcctttatggccttttcgactgtttggggattcggaaatgtggttaatggttttgtatactttaacggagtccaagtaatttttagttggatcatgatgtttgcactatacttcgtaccatatgcattaatggtaggagagttaggctcagcatttaaaaatgctggtggtggtgtgagttcatggattcaagaaactttaggaccaaaattagcttactatgctggatggacttattgggttgttcatatgccttatattgcttctaaagcatcaggtgggctaaaagctttaagttgggtattgttccaaaattcatctttttatgattctttggatattcgcctagtccaaattattaccctggtagtatttttagtatttgcctgggtagcatcacgggggttaaatccattaaaatcattggcaactattgctggatcgtcgatgtttgtaatgtcaattttatttattatcttaatgatggcagcaccggctttaaatcctaatggaggatatcaaactattgattggagttttaaaaatttaattccatcgtttaggttagaatattttacttcattatcgatattagtatttgccgtaggtggatgtgaaaaaatttcaccatatgtaaataaagtagaaaatccttcaaaaggatttcctaaggggatgattgcattggcaatcatggtaattatttgtgccattttgggtacaatttcaatgggaatgatgtttaatgttgctgaaattaatgctaattttgattcatatgtagctaatggagcatattggtcattccaaaaattaggagagtattatggtattggtaataccttcttaattgtttatgcagtatgtaatatggtcgggcaattatcaactttggtaatttctatcgatgcgccacttagaatgttattagacaatgaaaatgcgcgtcaatttattcctgcaaaattattaaagaaaaatgacaaaggcgcatataccaatggaattttgttggtagtagcaattgttacaccattaattttaattccggcgttaggaataggaagtgttacggcatttttaaaattcttgacccaactaaattcagtttgtatgccactgcgttatttatgggtgtttattgcatatattgcattgcgtaaagcaattgataaatttccagcagaatatcgctttactaaaagtcaattttttgcgaaattttttggatggtggtgttttattgtcactgcagcttgttgtgctttaggaatgtttaaaggaagtgcatttgaaatcgcaatgaatattattaccccaattattttagttggattaggagcaattatgcctgctctagctaaacgtggcaagacaagtcaatagtatcttagacatatcctttaacacatgttaaaggatatgttacaatagagccgtaattatggaggtcatgaaaatggataaacaaatatcacaggaattagtaacttttattaagcaaagcccaactgcttttcatgctgtagctaatatgcagaacattttaattgaacatgggtatgaagaattattagaaggacaaacatggcaaattaagaagggtggtcattactttgtcactagaaataattctagcattattgcttttaatcttggtgagaatttagataattatagttttaatgttgctgcatcacatagtgattcaccaacttttaaagtcaaagagaatgctgaaattgaaataaaaggtaagtatacgcaattaaatacagagggttatggtgggatgttatgtgctacctggtttgatcgcccattatctattgcaggtagggttttagttcaagaaggtgataactatgttaccaaactagtaaatattgatcgagatctagtaatgattccgaatgttgcaattcacatgaatcgtactgtcaatgatggttatgcttataataaacaagttgatatgttaccgttatttggtggatctgaaactaaaccaggagatttaaagaaactgattgctgatgaattaggtgttgatgttgaaactatttatggaacagatctatatttatataatcgcatggaaccatcaatttggggagctaatgaagaatttatttcatgtccacaactagatgatttacaatgtgcatatacttcattacaaggttttctcaagggagcaaataagcaatcaatcaatgtatttgcctgctttgataacgaagaagtaggttcaggtactaaacagggtgcaggatcaacatttttatatgatgctatgcgtagaatcaacaatgctttaggaaaaggtgaagaagaatattatcgggcattggcttcaagctttatgttaagtgctgataatgctcatgctgtacacccaaatcatcctgcgaaaacagatgttaataattgtgtttatatgaatgagggtattgttgtaaaatctcatgctggtcaaaaatatactagtgatgcagttagtatagctgtttttaagggattatgtaaaaaggctggagttccagtacaatttttctctaatcgcagtgatactgctggtggtagcacgttaggtaatattgcaatggcacaagtttcaatgaacagtgttgatataggattacctcaattagcaatgcattcatcttatgaaacagctggtgtcaaagatactgcttatatgattaaagtgatggaagaattctttaatagtcatattgaagaaatgagtggacatattttaaaggttactaaataatgaaaaaagaaaaaactagtaaaaagcgattaaaagagataaaaaaagaagtacttgaaaagtatattattgctggtttatggcaaacgatgtgtggctatattgttttactttttatcaaagaattattaactgataattatttagtcagtttttctgttgatgttttgattgcgattattgctttctatgttacattacataatctagttaatcaatacaaactaattaaggaaaatcggttgtcattaaagcctttctcttttcaaatttttggaattattgttggtttgttcattgtaatacttactttaaagagtccttttgatatttcttttgcgattcttgtaattgcttttttaacaagtaaaaaaatgtttgaaaaagaactaatgaaataactgtacgtttgtatggctattttgataactactttttataatgttatcagattaataaaaaagtcacgatattgatttgtcgtgactttttttagaataattaatttaatgagataatttttcttcttttaatttattagcaacatccatttgatgttctttttcttcttgaagtttgactgccatttcatcagtagttagtttatgtgtttttggttcttctttagctttaccaaaaactttttcaaaagcttcttctgcttctaaatcaattttttgttttaaatcatttaattcatgtaatttagcttcatgatgagcaatttcttcattaacgatagctttaatttgatctttagtaagtggtgtaacattttctttaataagatctttaccttcgttaaaataagtttttaaagattcaatagcttgttcattgatttttttagtattcataataatttccctctttcttttgttttcatttgtaatatatgcttctgtgcaaaataattctatatataataatcatttataaatgctgttaacaaaatttctactttcaatttagattatttgttaatggcattaacaaatgttatttccttaatttagctgtttttaatttatttgcagtttcaatttgatgagttttttcttcttgtagtttaactgccatctcatcaacagttaatttatttggagattttttgctggtaatccttttacctaaaaccttttctaacgattcttctgcctcaatagcaatattttttctcagcacttcaagtgattcaacttttttttcttgagcttggatttcttcgttgacaattttagttatatcttctttatccaaaggctttcgctcaaaatcattcaatactttatcgggattatctttaaagtaagtgtttaatgaattgagtgcttgtttttcaatttctctcttattcattttaattaccttctttccttaactacactcgtatcataatcgttactgataattttggaaagtaaaaaatagttgatttaaatactattaacaaaattagaagtttttttatcatagttctgttaatgttgttaacaaaatatcgggaataaagttattattcgaaagattaattttatatctaataatattttttgaataagtcgaaaaaagcttaaattactgtataaattagttatattgttgctttatcggcatatagtcttaaagaggtgatatcagaagatgagctcaaggattgcttacaacagtaaggaagtagaattactagcacggttgatcaaggctgaagcattaggcgaaggtcaagaaggaatgctgttagttgggaatgttgtcgttaatagagttgctgcagtttgtgatgtatttaaaaatgttgttactattacggaagcaatttatcagaaaaatgcttttgctggagttggaacagatttatttaatggacctgttaataccaaagaaaaggaactagcgcttaaaacaattaaaggttatcggaatgctccagcaacatatgcgttatggttcaaaaaccctggggataatgttacttgcccaaaaacattttatggagaattttcgggtcgatttaagaatcattgtttttataatcccggaccaaatttagtatgtgaaatctaaaggagatgcatttatgaattattttgaagatttaaatccttattttgttagacaggatccagatgctgaagtgaatcctgacggtacactgataccgcctaaaaaccctaatccggcagctgtaccacaaatatatatgggaaatatcattcgtttgaatatcggtaagcttgggactttttatttcacttatagtgatagtgagaaatggcgagatgaagtttttgttggtatagttgaggatgcaggtcgagactattttattattaaagatgtaaatagtgaagatcggtttttattaccgttagtatattttttatgggctcgatttaagggcgcaatctcgtttacggtaccgccacaataactaataataaaggatagccactttaatgataaatttttgaggttatcctttgttgttataataaagcttctaaaaaaatgtacaagtagatatacaatccttattcttaatactataataaggttggagggataattatatggcaaccggagacgtaatcgattttttggaaagggaaggatatgacttagattttattaagacagcaaatcgttatctttcttatgattctgaacatcttattttgcaatgtaaaaatgatatattagaatttggtgaaaaagaacttgtaaaaatgtatttagataatgacattttttatagttatactttgagtaggttcaattcaaaggttgggttagcctattttgaatgtaccctgaaagatgctttttcaatttttacgttgcaaaatatttaaaattatgtgttaaagctctactaagatagagcttttttgtatatagaatatttttcagttacttaccctcttgacattaaagttaactttaggtttatactaggcaatgtaagggggaaaattaatatggatgaattttatcaagatttattagaaccggttgtttatcgctgggttaagacgcatgaacatatcaaagtctgtgaaaatcaatgcactctatgtattgatggaagtaacagtaccggaataatcagttttcataatgagggaatcgttgaattgagtgtaaagaataaagatagtgatgaaatattgttttatttacattttcaaatgcatgattttaaatctacaatgaatcaatttaatacattttttaattatctttgtttacccacaattaagcttggtgagagcattttcaataatgtaaatactaataaaattttacttagttgtagtggcggtctgacaacttcatattttgcttattcaatgcaggaaatttttaaacggcagggcttggatatagttgttgatgcggtaggatatatggaaattgataaagttattgatgattatgatatggttttattagcaccacaagttgcttatttactgccacagttgaaaaataaatatggaaataagatttttattattgattcgctagattttgcaacgaatgattttaatgccattataaaaaaagcagttaattaatgaagcattagataagttcaattactttttttaaaaagaaatctgcagctttggaaaaaatttgatattttttccaaacaagatctagtccaacttcaagctttggctctaatggtttaaaacataatgtactattgtatgtattaattaatttatcaagtgttaaggcatatccagaaccttcatcaactaataatgaagcattgtagattagattataagtagcgacaatatttaatttgtcaaaatcatcttttagccaccctgaaagttcatttcgaacaaggtcttggttagaacaaattagtggcaggtcttttaaatcctgggggttgatatattctttggatgctagaaaagcgtcttttttcatcaatacaccccagcaatcggtataagggagcttaataaaatcatattttgaaaaattagtcggctcaattaaaattccaaaatctaatagacctttatcaagtttttcagtcacatcttgggcatttccactatagagatgaaatttgatttctggatgaattttttgcgtttctttaatcgctttcgttattaatcgcattccttctgtttcaccaccaccaatataaatatcaccactaatagtttcattatcagaagtcatttctgcttcagttttattaactaagtcaataatttcttcggctctttttctaaagagaattccatcatctgtcaaggtaatccgacgattacctctaattagtaactgcttaccaagttcattttcaagatcttttaattgtcttgacagggttggttgggtcatatgtaaataatcagctgcagcagaaatactttcttcacgagctacagtaataaaatattttagaactctaagttccatacagatcaactcctttaaaatattttaacatgcatcaatatgcctttcaagcataggaaactatttaatataagtatttgctatccgaaaagctatattttagaatatagctgaaggagatgataaagtgatgtgttcaaatgatacacctgaagcggtatatcaaaacttattagatgcaggttgtgatagtaaattagtagatagatttatgctattatttgcacataaaaactatcaaggacaattacaaattttgtcagaacaaagaaaggaattattagatgaacttcatctagttcaaaaagaattagactgtttggattatttaatttataaaataaaaaagctttatttaaatgactaattgattatttatatgacaaaggggagattttgatgggttacactattcgagaagtatctgaaattttaaaaataccagtttcgacgattcgctattatgaaaatttggggttattaccagtaattcaaagaattgaaggaaaacgtgtgtttacaaatgaaaatattactgatttaaagcgaataaaaaaactaaaagatatggggatgacattaaaagatattaagaatttcaatcaattatattcaaagggaaaactgtcatttgaacaaaaaattatgatacttgatcaacaacatactgtaattattgaacaaattgaagaacttcagcatacgctagagatcattgaaacggaacgtttaaaatatagcaatattatcaataaaaatcatactgcaattatttgcagttaataaataagatgaaaaagaaatatatttttttacttctagtattaatattgataggctatctggttaaacaaaatatagataaacaaggaaaagaagaatcaaaagaaatgataaaaataaagattgagattaatggacaaatgtttttagctacattagatgatactccaacatcccaggctttattggaaaaattgccgatggtacttacaatgaaagagttaaatggtaatgaaaaattctataatttagaatactctttgccagtaactagtcaatcagttaatcaaattaataaaggagacttgatgctatttcatgacaattgcttagtattattctatcaagacttcttatctaagtatcagtatacgcgaattggtcaaatagatgatgcaggtaatataaatcaaattgtgggtgcaggagatctggtagttagctttatgaaatatagaaatggagaagaaaatggaaataattaaacaaaaatatttaagcggtgaaagagcactttttaaaagtaataatctaaaaattgaagattctatttttgctgatggtgaatcaccgttaaaggaaagtaagaatatagaaatcaatgagactatttttaaatggaaatatccattatggtattgtaatgatgttaaagtcactaattcaacattgttggaaacggcacgctcaggaatttggtacactaaaaatattagtattatagatagtattattgaggcaccaaaaacatttcgtcgagcacaaaatatttatttagaaaatgtagatttgccaatagcgcaagaaacgctttggaattgcacggatattgttttaaaggcagcgagggtacatggtgactattttgggtttaatagtataaatattaagattgatgatttgaatttaacaggaaattatagttttgatggtggaagaaatattgaagtgcataattcaaagctgatttcaaaagatgccttttggaattgtgaaaatgttacagtttatgattcaacgatcattggtgaatatttaggatggaattctaaaaatataacgtttataaattgtacgattgagagtttacaaggactttgttatattgaaaatttaaaactgattaactgcaaacttattaatacaacacttgcatttgaatattctacagttgaagttgaggtaaattcgcatattgatagtgttatgaatccaatctcaggtgtaatcaaagcacatagtatcggtgaattaattctagacaagaccaaaataaatcctagtgaaacaaaaattgtgataacaaatcctccaataaaaagccaaacaaatatcgaatgtatatgttgttagaggaggagaaaatgaaaaatcgattttcaaaactgacgaaccgctggaatagtggttctttgaagtgggaaattaaagagaatgaacttcctatgtgggtagcggatatggattttgaaactgcgccagaaataatcgaggctctaaaacaaagagttgagcatggtatttttggatataacatcgttcctgatgaattctttgaaagtattcagacctggtggctaaaaaggcataattattatctagaaaaagagtggatgttattttgtacaggggtagtcccagcaatttcttcactcgttagaaagatgacaagtgtaggagaaaatattttaattcaagcaccagtatataatattttttataattctattttaaataatggacggcatattatttcgagtgatttaatttttgatggaaaagaatattatattgattttgtagatttagaaatgaagctggcagatcctcaaacaactatgatgattctttgtaatccacataatccaattggaaaaatatgggacattgaatcattagagcggatcggtgaaatgtgcgctaaatataatgttttagtaattagtgacgagattcattgtgatcttactgcacctaataagaattatattccgtttgctagtgtttcaaaagttaatcagatgaatagtattacttgtattgctccaactaaagcttttaatttagctggactacaaactgcttgtattgttgtcgctaatccacaattacgacataaggtaaatcggggcattaatactgatgaagtggcagaacctaatagttttgctattacggcaacagttgctgcgtttactaaaggggcagtgtggcttgatgaattgagggaatatattgaagaaaataaaaatatagtatctaaatttattcgatgctatttaccagaaatttatttaattcctagtgaggctacttatttattgtggcttgattgttcacgaataacaactgacagtacaatgttaacacaatttattcgcgataagacgggtttgtatttgactagcggaattgagtatggtgaaaatggtaatggatttattcgaatgaatatagcttgtccacaatcacgattattcgacggtttagagagatttaaagagggtataagagcctatcagcaaggagaaataaaaatggaagagattgacatagaaaaaatgcatcaatttgaagatgttattaatatggaaatattttataataaaactactcaagaaattatggaacaatactatttgcaaagagaaaatgcagattctctagcaatgcaagattttacgttgactgacgaagaattaagggtgttggatcaattaataaaaatttaattaaaaaattatattaaattgctcttttctaggaaaataagtgaaataaaaacttgtacttagaagggagcatattttttattggaatgttatattaattagaaaagaaaattacaagccattatataattaactgattattatttttttatatggtaaaatattcttgaaatttgataacaaaggggaaagtttatggaaaataatcagaaaaaagaagttaatgaagcacttcatgcaattgaagaaactttaggtcatttatcaagggctcaggattatttaagtagtgcaggaaactggggactttttgatatgattggtggtggttttattacaacgatgatcaaacatggtaaaatgaatgaagctgaaagagcaatggcagcagcacgtaattcgatacgaaatctaaaaaaagaattaagtgatgtagatcagctggttgatgttgatttaaatattagtgattttttaagttttgcagattatttctttgatggaatcattgctgattggatggttcaatcaaagatcaaagatgctcgatttcaagttgataaagctattcgagaattaaatcgtattaaaaatacgttactgacccttgcagtctagaaatattgtaaaatgaaggtatgatttgatattatggataacataatcaatcaaatgattgaagtaactacttagtttgaagatttagaagtacaatttttaaaggtaacaagttgtttaaaagaaaatggattaatgttaatatatggttttcaaccatttatgaatatgttcgtactgtctgaagcaagtgtatttgatgaaaattcatttaaataaaattgaatatttgtattttgggaaggaatcttagaaaaatactgaaatattttatataactagacaacacaaatcaaaagaattcactagtttttggcatatattcagtggaattattaatgtatttacttatgtaagtatgaatgtcataagattaaatgaaagagaagtagaatttatataatgaaaacagtctataataggatagactgttttatagtacgatggacttattttaaattgctttagattggattaggaattttgtcataaattttatataataaaataaagtgaggtgtaagcatggaattaagagtacttaagtattttttagcggtagcacgtgaagaaaatatcacaaaagccgctgagtttttacatataactcaaccaaccttatcaagacaactgatgcagcttgaagaggagttaaacgcgcaattatttatccgaggaaaaaatcgaattgttttaacagatgaaggaatgctgcttcgaagaagagctgaggaaattgtagatctagctaataaaacggaaaaagaatttttagaacaagataatctagttacaggagaaatttttattggtggtggggaaacaaatgctatgcatattcttgctagaataatcaaagaatttaaagaagaatatcctcaaatcaaatatcaattttatagtgggaatgctgatgatattaaagagcgtttagataaaggattgattgatattggtttgctgactgaaccagttgatattgaaaagtatgagtttgtacgcttagagcaaaaggaagtttggggtattttagcacctaaagatagtaaacttgcagctaaggaatatgcaacaccacaagatttattaaaattgccattattaagtactcgaagaacaatcgttcaaaatgaaatagctaattggtttgggcaagattatgagcaattagatattattgcgacatacaatcttatttataatgctgcaattatggtagaagaggggattgggtatgcgatttgtttagaaaagttagtcaatattaatgatgaaacaaaaattcgctttattccattttatcctccattgttaactgggacagtaatcgtatggaaaaagcatcaaattttttcacctgctacagcgcgatttattgaaaaaataaagcattctctaaaagcatgattgattatagattataggtattagacatataatttctgacgatttataataacattgaaaagaaaggatgaattataatgacaaaacaagctgttgcaccacgaacaatttttatgacggaaaaggattttcagcccattgatgaaactagaatttattggttatcaagcgctggtgtgatgatcaatagtcacggtactactttgatgattgatccattattagaaggatttgatctacctttattagttgaaatgccaattttacctaaagatgtacctagtttagatggagtattgattacacattgcgataatgatcattttagtcgattaacctgtaaaaatttagctccagtgactaaatcatttcatggtcctcattatttagcagaattattcgcagaagaagatttaaaaggaaatggatatgatattggtgaatcatttgaaattggaaacatgaaaataaaattaactcctgctgatcatgcttggcaaaatgaaagtagtaagtatagtaaaattcgtaaatatcagtttgaagattattgcggttattggattgatacacctgatgggacgatttggatggttggagattcgagacttttacaagaacatctgcaaatgccagaaccagatgttatgttatttgatttttcagataattcttggcatatcggcttagataatgcgattaaattggccaatacatatcctaatacagaattaattttaattcattggggaactgttgatgctccggaaatgaatgcatttaatggtgatcctaagtctttgaatggacgtgttgttaatccagaaaggattagagttgtagctccaggggaagcttttgtattaaaaaaataaaattgttagaaccaagttgtcattagtatagcttggttttttgatatatcaataatgctttttaggtattattgataatacaatataggtattagacataacaatataattaacttaaaatataagtgtatagataaggtaatggaggtgaaacatcttgagaataaaagaggtaagtaagagatttaatgtttcaataacagctttacgatactatgaaaaagttggtctatttgaagatgttaaccgtgttaatggtattagagaatatgaagataaagatattgaaagattaagtttaatattaacattgaaaaatattggcttgagcaatgaaactattttgaaatatatcgaattaaatgaacaaggggcacatacgaagaaacagcaaattcaggttttgaagttagaacgtcaaaagctattagatagtattcataatcaacagaaaaatatagattctttggattatttgatttaccagttaaaagataaggagaagataaaacatggtgagcaaaagtagtaaacattggttagttttaattgtatgttgtggtttagcggcatcttcaataggggtttcaattaattcgtcaggtgtcttttatacacctgtttcaactagtcttggaattatgcgtggaacattttctatgcatatgactatcttttcattaacaacagcaattggggctttattcatacctagaattatgaataaagtatcttacaaactattactgacaattagtgttgtaatagcagtagttgctacaggattgatggcagtaactaaatcaattccgggattttatctgctgggagctatcagaggacttagtacaggtatgttttcaattgttcccttaacaataattattaataattggtttgaaaaaagtcatggtttggctactagtattgtctttggattcagtggtttagcaggatcgatttgttcaccgattttatcaagctttattgaaaattttggatggcaaactggttatttaatcaaagctgcaattatattaggattatgtttgcccgctgtcttatatccatttcaccttgatccacaaaaagatggttgtttaccttatggacatgtggagcagccacaagatatggtgacacaagtgtcaaattcatttagctttacaacagttgcatttattagtttctttgtcttcggattattatgtagttgtattactagtgttactcagcatttacctggatatggtcaatcattgggctatagtgctgcattaggagcaatgcttttgtcatcgggaatggtaggaaatattatttccaaattgattattggagttttaagtgatcatttaggggcaattaaagcaactgttacaatgatcatagctaatactgtaggaattattttattaatgtggggttcaacagcgtggctattaattattggagcatttttgtttggttcatgttattcaattggagcagtggcattgcctttattaaccaaatgcttctttggaatagataattatgcaagagttttcccaaagatttcttttgcttctaatttaggagcagcaatttctttatctatggtagggtatatatatgatttctttggctcttatttatatgcatttatcattgctctagcaatgattgcagtttgtgtaattactttaacattaactgccaaaacaaaagaatagaggaggaaagattatgaataagaaagcagaacagttatttagtgatttaaatgatggaaaggattttttagtaaaggatccagaacttcgggaaattatgattaattatctttatggggatgtctatcaccatggtaaccttgattttaaattaagagagcttattttaattgtcgttaatactaccaatcatactttaaaggctttaaaggaacatgtgacaagtggcttgagtgtcggagtaacacctgtagaaattaaagaagcagtatatcaatgcactccctatataggattaggcaaagtagaagaagcattagaaatagttaatcttgtttttgaagagaaaaatattagtttaccactattaccacaagcaacggtacaaggtgataatagatttgaaaagggatttgcagttcaaagtgctgcatttggacaagagcatattcaagcaggtcacgaccatgctccaaaggaattaaagcacattcaaaattatttatctgaatactgttttggagatttttatacaagaaatggtttggatttaccaacaagagaattgattacaatggtgatgttagctactttaggaggttgtgagaatcaattgcgagctcatgttggggcaaatctaacagttggaaataatcgtgatactttaattgaaacaatcactcaatgtcaaccgtatataggatttccaagaacattaaatgcaattgcaattattaatgaaataactaagaaataaaaatggaggaatgtaaaatgaatcgtgaagaaagtttaggaccatctgcagtatttgaattaggagaacctaatgatgcgtatgcaaaatattttattggtcaaagttatttgaaacatctaacaacagaaggagttggtgttgtcaatgtcacatttgaacccggttgtcgtaataattggcatattcatcataaaggtggtcaaatcttaatcgttactggtggaaaaggttattatcaagagtggggaaaaccagtacaatgtttaaaaccaggtgatattgtaaatattccacctgagataaaacattggcatggagcagtaaaggatagctggtttagtcatttagctgttgaagtgccggctaaggatgcttctaatgagtggtgtgaaccagttacagatgaagaatatgaaaaattataaaaggagataagacaatggaatatgtaaaattaggaaatacaggtttagaagtatctaaaatatgtttaggttgtatgagtttcggggatcctcaacgttggatccatagttgggtactgaatgaaactgattctcgtaagattataaaaaaagcattagatttaggaatcaatttttttgatactgctaatgtttatggattaggggccagtgaagaaattttaggacgagcgcttcaggagtatgctaaacgggaagaaattgtaatcgctacaaaagtaagcggtcaaatgcatgaaggaccaaatgggaaaggattatcgcgaaaagcaattttgcatgaagttgaacaatgtttaaaaagattgggaaccgattatattgatttactttatattcatcgctgggattataatactccaattgaagaaacgatgtgtgctctaaatgatttggttagagcaggaaaggttcattatttaggtgcttcatcgatgtatgcctggcaatttcaaaaagcacagtatcttgcagaaaaaaatggatggactaaattttctgtaatgcagggtcattataatttattatatcgtgaagaagagcgagaaatgattcctttatgcaaagatatgcaagtagctttggtgccttatagtccactagcggcaggacgattaactcgtgattggaattcagattcaaaaagagctcaagaagatttggttgcaaaacaaaaatatgatagtactgtagatacagatcgaaaaattgttgaaagagttgctgaaattgcagataaatatcaagtcactaaatctcaagttgctgttgcatggttatgggctaaaggcgtgactgcaccaattgtagggattacaaaagaaaaatatttagacgattttgcgggtgctttaacagttaaactaacacaagaagatatagaatatttagaagaatgctatcagcctcatgtaattatgggacataattagaaaggatgaaaaaatggtgaaaaaattatatttaatgcgtcatggacaaacactatttaatcttcaaaataaaattcaaggctggtgtgattcgccattaacagagttggggcagtatcaagctaaagtagccggacaatattttaaagatcatcaaattacttttgatcatgcctattgttctactagtgagagatgtagtgataccttagaattagttacagatatgccgtatacgcgtttaaaagggttaaaagaaaatttttatggtcaattagaaggtgagagtgaaaggttaaattgtcacttgacaccaaaggattgcgaaactttctatttacaatatggtggagaatcttcaaatacagttagagatcgaatgatgcagacattgacaaatattatggaacgagatgatcattttaatgttttagctgttagccatagtggagcttgctttaactttttaagagcaattcaagatccaactgaagaattaaataaagggtttggaaattgctgtatttttgtttatcaatttaatgatggagtatttaagttggaagaagtaattagacacaaatataattaaaaatatccacttcattatgaagtggatattttttcatttgcacagcaagtaggttaactgtcattcctgtattgctaaccaacaatattttcatcttaagtatctttattaatgatagataaaacgttgggatatttattgcaagtatgctcactgtttagaatggaaattatgttagtaataaatttatttttaagttagctttacagcgattgataaatagtttacttgttttaaaaagttattcatattatctcactcctttatctatcattgtgcttattatacaaaaaatgggaacagattatagactctttaaacattatggaatatttttgcagctttttgattaaagtagttagaagaatagaaaaaattttttcaaaatttggtatagtaacaaaaaagataggataactgttataatttagtcattaatagaagggagcttgaaaatgttttgtgattatcatgtacatacagagtatagcgatgattcttgctatctaatggaggatgttattagggatgcgatcgttttaggtattaaagaaatatgttttacagatcatgttgattatggaatcaaattagattgggatgatccaaatttaataattaaagagaatgaaaagactattgccaatgtcaattatccacagtattttcaaaaaattgattctttaacagagaaatattgtaaccaaattacgataaaaaaaggaatggaatttggaatacaaatgcatactattgataaatttcaaaaactttttaataaatattcatttgattttattattctttcaattcatcaagttgaaaataaagagttttggactaatgattttcaagctggactaagtgaggctgaatattatcaaagatactaccaagaaatgtatgatgttgtaagaaactatcatgattacagtgttttgggacatatggatttaattaaacgttatgatgataaagatggttatgatgccttcaatgaacacaaggagataatcactaggatacttaaatatattattgaagatggaaagggaattgaattaaatacatcttcagttagatatggtcttgatgatttaatgccatcacgtgatatttttcagctatattacgatcttgggggaagaattattacaataggtagtgatagtcacgaaaaagttcatctaggtgctcatattgaaacgatgaaaaaggatttaaaaaagattggctttaaagaattttgtacttttaaacaaatgaaaccaatttttcataaattgtagaaaatggatttttaatagtccatttttatattaattttattttaaaataatggtgataatctaaataatttaagctatagaaagaaataaagatgggttaccgcatataaaataaaagttttagagagatttttagttattgatgaaattaactaatgctcaaagagaaaatctccaaattagcagtttatattggaagaagtttaattatgctttgaaagctgctctgttaccatgatctgataattggataaaatacttgggttcactttactaggtatcttttttattagctataactaattatatataatataatgaaataaagggtgataattatgagctatttatttgatagttatgcaaagatatatgatcattttatgcgcttgtttcatttagatgatacaagtgttattgaacacaaattatcgaaggggcaatatcatattttggatgttggcggaggaagtggaacactagccgctgatttacaagctgctggtcatcaagtcacaattgtggattctagtttatcaatgcttaaagaagctaaaaagaaaaacactaatgtaaaattaattcatgcatcgatacaaaaaggtcttccaataaataaagtcgatgttatcatttgtcgagattgtttacatcatttaatgaatcaagaaaaatgtcttaaattgatgctaaattatctaaataataacggttttattttgattcatgattttaatcaaagagcatttagaataaaattactttttctttttgaacgttgttgttttgaaaaaataaaaccagtcaaacctgaacaattggttgatttttcgcttcaaaataagctgaatatagtatttctacatcaaggaaagtgggactatatatgcatgttaaaaaaagaaaaataattagtttattccatttaggaataaaggtaggatatttatttataacaagaaaaattgtgactagaagtgatattggcaattcttatgatctggttagtaaaacttatcagcaagaatatttaaaaataatgcatacatataatgatattcttttaaatcatctaatcaaacatatttctaaaggccgtattctagacttggctggaggaactggttataattcaaattttatccaagaatataatgattattcaattgatcttgtggatatttcaaagcaaatgttaaaacaatgtcagaattcaagcattaataaagtgtgtaaaggaatgcttgaatttttaacagtacaagaaagttgttgctatgatgcaatcgtatgtacttgggcattgatgtacgaacaaccacaaaaagtattaaatcaatgtcagcggttattaaaaaatggaggatatttgtatatcttagtaaatgatcagcaaacattgccacaaattcgaaaaatttatccaaaattattaattgaatatgtaggctcaattaataaattaatgtttgatttaccaatgccaaacaatgcgcagcaattggaacgttgggctaaaaaagcaggattaaaaaattgtctagtaacttcaaaaaaacaagaattttatttcacagattggaatcgggccgcaaaatttgttacctcaacaggtgctttggctggttatgatgcaatgttggatttgaaaaatgaaaaaatttttaatactcttgttgagcagctgcagaagttttttactaaaccatgcattactcatcatttcgtgatgggaatatttaagaaggggtgacctgagtgaacaaacggatgattattaaaatgtgtatcaatccccacattattaaaacatttttaaatttgcattaccaatttcgcaagcatgaagattataaggttagaaatatggtaaaatgtggattaaatataattataaatgatcatttagtccagcatgatggttattatttagtgaattcatttattccaccgattaatactgaagcttttaggacagtagttaagatggttcctggtaaaggaaaaaatttttttgttaatcacactgaagggattcggctggctccgatttctacatatattgctgttacagataaatgtatgtaccattgctggcattgcagtgcatctaagtttatgaaagatgccacatcaaatagtcaattttcgactttagaattaaaaaaaatcattgcccaattacaaagattaggtgtagcaattattggttttacaggtggtgaacctttattgcgtgaagatttagaggagcttattgcaagtattgatgaacgtagtgttagttatatttttacaaccggatataaattaacttatcaacgtgctctggctttaaaagaagcggggttatttggtattgcaataagtctcgattctttagatgcccaaagacataatggaatgcgccataatgatcatgcttacgattatgctgttgaagctattaaaaatgctaaaaaggcagggctttatacaatgagtcaaacggtatgtacacgagaattactgattaatggaggaattttaaagctggcactgtatttaaaaaaattagaaatagatgaaatgcgaatcatggagcccttaccttgtggtgctttaaaaaacaaattggaagaagttctaactgataacgaaaaagaacaattaaagcaattgcatattacattaaatagagattctcgatatcctaaagccagtgtctttccatattttgaaagtgcagaacaatttggctgtggagctggagtacagcattcatatattgatggacatggtaattttggtccctgtgactttattgagccgacatttggaaatgtgttgaatgaaaatattcaatatatttgggtaaaaatgtcaaaagcaataaatggcccgcattgtcaatgtattgctaaaaattgtgatatttgtaaacaattacctcgattttataaactaatgcgaggttataaaaaatgagaaagcaagtgacttatttaggaaatattctttgctatgaaattgaaaatttaaataaaccagtctgtatttgttttcatggaatgaatatgactagagaaatgtataaaacagatcaactgcaacatttattaaaaaattattctttggttttagttgatttatgcggatatggggattcttcgatagaaacaaagaattttaatatggtagtatttaatcagctggtattaaaattagtgaagtgcgaaaatatcaaatcttgtactattgttggatattgtttagggggtgtatttgcacttgattttgcgattcgtaatccatattttattgagcgtttaattttgatagaaacaatgatttatttaccgaaatggttatggttgacactgttgccaggatactgcagcggctatcgaatatttcaaaagcagattaagttatttaaaatattagaatgttgtacgaaattcaaaaacattagttcatcagaacgaataagaatatcgtcaagggaatggaatcgtactgttaattcattttatttaaagcttatgaatgagtatgaaaaacaaaatcatattaagcgatgtcaacaaatcaactgcccagttaatataatttatagtcaagccagttttaaaaatattcgaaaaactgcgcaaatcttatcacagttttcatttgtagaactccatttgtgtcaaggcagaggtcattttttgtttcttgatgagactatgaatagaatagtgatataaaggctggaagggaagaaataatgcagaagaaaacaattattatgggaatagtcatatgtctattagggattggttattttttattaaataagccttgattatctgatgaagatggagaattatttaattatctacttaatggttataatcctgatttgtcaatcacagaaattatagttcaagagggggaagaaagattatttaatctctttacattaattgacgaaaaatctaattatggtgaacggtttaatgattgtactctggtagagcaaaatttttggtttctctataattttcatatggaagttgaatgtggggggggagttgagcagtttatttcaaattattatcatcattctgattttacgcttgaagcttttagagatttggaactaacgataagtaaagattatttacaagctgcaattaatatctatccaaataaacgaatcgagatgtactcaaatcaagaaatcagtaatcaattagatcaaattgatgaacagtattatgctgatcatgaaatagaatattttgattttattgataaatacacagaagaaaatattgtaaagatggatgaaatcatgtttaaaattggagcgttttctaaattaacataggctactgttagaatgttaagatattatgatgaaatgggacttttaaaactggctgcagttgattaaacaactggatatcgcgccatgtattcaagtgaacaaattcttcgcttaaataaaattatatatttgtaaggtagtggatttaattaacagagatagcacttgttttaaataaccaaggaaatcagtttattattgaataactggagcaaaaatatattggaggaacaagtaaaattaaaaaaatcgaattagcaaaaaaagaattattaggtaataaaaatgggatgaattataatgttctaataaaataaactccaagttattttgtactttcattaagaaaaataatttctgattattatgctgaaagtaagttgtaggaagaattattaaactttactgctgagcatagaagagatgtttcagcaaaatatttttcaatttattatgatgaagattaccgtgaatatgatgttgatgtagaattgtgagtatcaattagaaaagctgtcactatcgagaagctttttaaatttcgatacacctcagctgttgaaataatggcttgtatggtgatatatggagatttttctaatattgctgatacttatttatcattagtaaattggttacaaaaaatgctcagtataagatttcaagatccaattgctttaagtgttgtagaagtcatcgtaatcgattatcaaacagagatagttagtatcccttatattgatatcaatccatatacaccaaatcttgaagaatcggcttattttgcatgggcggatgaatttgatttttaatcattttcaaaataagaaatggtagcaagtttgtaaataaacttgctaccatttttgttatttatgaaccgtgaccacactagtttttgaaagataatcatgtaacatacgatgattagaattaaggaggctcataaacattgaaataaacgatactattcctaaaattgataatgcaaatgaagctattgatgcttcaaagataatgtttatcagttcccaaaaatagattgagcagctataaaatgtaccttcaattaaaattaatccaactccatttctaattaataaagtttttaaatcaatattaatttcattattcttaacaatttttaaaccaaagatttttttaccaattgtttgaccattatatttgtaaggaaaataaactaaatatagtaaagagagcagtaagcctattaaaaatgcactaattgcgggaattagaggaagattgacaattgaactagtaaaattcttttgatgatagataatgctataaattaagtttataggtaaaattgtcatgacactgatgatataccagtcaataaaatatgcaattagtcgtttaacaaatggtgcttggtgattatgtactgatgaatggttaaatattcttttcatgattgacgctccttaagaatcttcttataattttagtatagacaattcttttaaaatatccttacagaaaattactctaagcttggcgaaaaaactgcaaggacaaataattattaatagagtatatttattatggataaggagagattatgatgctaaatgaacgacagaaacaaatatttttatgcttagatgagaataaaaatagttttattaaagggattgaattagctaataaagtaaattgtagtttgaaaacattacaaaatacagtaaaagagatgaaaataattttagaaaaatatcaactagaaattatttcaatgacaagcaaaggatataatctgattatccatgatcaacaagaatataatgattttaaacagttattattagaaagtgatgataaaaaagattttaataatcagggttatcgaattacatatattttaagtacattattatctgataatcattttgttaaagcggatgatttggctagtcaaatgtatgtttcacgatccagtgtttcaagtgatttaaagatagtcaagagagttctcgaaaaatatcaattaaaaatagaacataagcctaattatggcatgattgttgttggcttagagaaggataaaagagattgtattattaaagagcaattagaattgcaattaggacattcaacaattaaaaaggaatggctagctactataagtgatatagttgttgatagtctgatgaaagcaaaatatcggattagcgatgtggtcttacaaaacttggttttacacatatgtgtttcaattcaacgaatgcagcatggaatatacattgataatccacaaatggcaaggcaatatgggcatgagcatgtaattgccaaaaaaattttggatgaattagcttcaatatatcattttattgttactgaaaatgaaatatcttttttagcaattcatctacttggaaagcgtagttatgaagaaaatgatttaatcagcaaagaaatcgattattttgttaatggcatgttggaggaaattaagattaaaactgatattgatttttatggtgatgttgaattgaagatttcattggctttacatctggtgcccttattagttcggctagaaagccaaatgcaattacaaaatacaatgattcaagatattcaggcgaattatcctttagcgtatgatgtggcagttattgcggcatcgtatatcagtgaacaaaaacattatcaactaagcagtgatgaggtaggttatttagcagtgcatttttctttatcgctttcaaaaaaagaaaataaaattaatcctaaaaaagtcttaataatttgtaatgctcgtagaggcgattatttaatgattcaacatacttttttaaaagagtttaatgaaatgatcagtgatttagagattatcaatgcgttagagataccacaatataatttagatgattatgactgtatttttgcaacatttttgaatcatccactgattcctaaacgagctttaagaataaatttttttattgatcaaaaagatattcaaagaataaaaaattctttacaaggtcaaagtgaagcaggtgaattattaaagtattttaaagaggagtattttatgggcatgattgatgccaaaaatcaaaaagaagttattcaattgatgtgtgaagttgcaaataaatataatgagtttgaagaagacttgtttcaatcatgtattcgtcgcgaggaattaggcagtacggcatatggacagctgattgctttaccgcatcctgatcatttgatttctcaaaaaacgattgttattaccgctattttagataaaccgatcgtatggtcgaagcaaaaggcacaattgatttttttgatttgtgttgaaaaaggaaatcaaaaagatttaagagtattatttgagtgtatttcaaaatttatgatggatcagcaaagtgttcaagatgttatttgtagaggtgattatcaaacttttacaaagaatttaggaaaactgattggataagggggagagaaaagatgaatgaaacaagttttgaattaattttacattctggaaattctaaatcatcttcgatggaagcaattgaatatgctcgtcagggggatattcaagaagcagattttaaaatgaacgaggctcaagaagagttattattagcgcataaaattcaatcaaaattgttagctaaaagtgcaaaagtagatcattttaatccaaatatgcttttagttcatgctcaagatcatctttgtggggcacaaacacaattagaaatggcaaaagaaattattagtctttatgagcaagttcaagaaataaaaacatatttaggtatagaaaattttcaaaaacaaaaaaatatgcgagtattgcttgtatgcggacaggggatgtcaacaagtttgttagtacaaacaatgtatttatatgctgatgaaggggattatattgaatcatcatcatttgaagaactagtaggtgtgataggtgattatgatgttgttttggtgagtccacagatccgttatcgaatgcctgtaattgaacgaatgatgacgctgcgtacacaaatagtaggactaatcgatatgaaagcatatgggaagttggatggccaaaaaatttataatcaagcaaaagaattatttatgaaaatcaagcattagagccagagtttgcatagaattgctctaagtatagcgaaattatgtgtaaggtaactttcatttataaataatataatgtaattgtaaagaaagggaggaaactattatggatagatttacacaaatgttagagaaaactctaatgccaattgctgagaaggttgaacaaaaccgttatttaagtgcaattcgtgagggcttcacgagcatcatgccttttttaatcattggttcaatattcttgttgttatcaaatttaccttcggaagctttaaataattttttaggaagtatttttggtgctgaaaatattgctaagttgggttatttgttagaaccgacttttaatattatggcactgcttgtaattattggaattgctaaatcattgttagaatatcatcatattaaagatacaagtgcattgattttaccaattattacgtttttattgttaaataattttacaattacattgacaactgaagctggtgaaacagtcacttcagggggagttattcctatgggatatcttggagctgcaggtttgtttgttgcaatgatttgtactattttgacagttgagagttatcattggatcaaagaaagaggatgggtaattaaaatgcctgattctgttccgccggctgtaagtcgctcattttcttcattaattcctgcggcaattatcttaacagtagtatttttaattaaagttatttttgaatatacaccatatgcaactgtatttgatttaatttatcaatgtttacaacagccgttatctgcactaggaaattcattgccatcacagatgatcagtgaggggctaattggtttattttggtgctttggagttcatggtgataacgtcgttagtgctattatgggtccaatttggcgcggtttatcagcagaaaatctagctctagtccaagctggtaaagagccaattaatattatttgtcaacaatttagagatgtatatttaattgcaggaggaactggagcaacattatcattgcttgtttctatttggtttggggcaaagagtccagaattaaagacagttgctaagttatctggaccagctgctatatttaatattaatgaaccggttatttttgggatacctattgtcttaaaccctataatgatgataccatttgtaatagtaccaatagttttatgtgttacgacatatctggcaatgagtttaggtcttgtaccattattacaggggattgagattccttggacaacaccagtatttatttctggctggatagcagggggatggaacgcattgattcttcaaattgtcaattttgctgttgctactgctatttatttcccatttgtaaaagtgttagatcgtgatttattaaaaaatgctaagaaaaaagaattgctacaagaataggaggactttatgcaagtttatgtatttaaaaccgaacaagatgttgatacatatgttggacagcaaattagtacatttattcaagataatgatgctccagtgattggttttgccacggggtctacaccattaggagcatacgactatttaattgattcataccaaagtggaaaaacagatttttcaaaagttagagcctttaatcttgatgaatatgttgggattgaaaaagatcatcctcaaagctttgcaagagcaatgaaagattatcttttcagtaaaattaatattaaagaagaaaatatttattctttaaatggaaatgctaaggatatgacaaaagaatgtaaagaatacgatcaattgatcattaataatcctatcgatattcaaatattgggaataggaatggatggtcatattgcttataatgaaccaggtagttcatttgatagtgaaagtcatgttgttgatttacaccccgagtcaattcaaagttcattggattatggttttacaaaaattgaagatgttccaacgcaaggagttacgcaaggaatcaaaacgattatgaaggcaagacaactaattatgattgccaaaggaaataaaaaagctaaattagtggaaagaatgttatatggtccagttagtgaagactttcctagctctataattcaaacacacaataatgtaattgtagtattagatcaatgtgcagcagccaatttgaaggaggaaacttatgaaaggcgttaaaatcgttacaattggaggaggcagcagttatactccagaattagtagaaggatttattaaaagatatgcagaattaccagttaaagaattatggttagtagatattgaagagggaaaagaaaaattagaaattgttggtaatctggctaaacgaatgataaaaaaagctggacttgatatggaagtgcatttgactttaaatcgtcgtgaagcactaaaagatgctgattttgtaacaactcagtttagagtcggacaattagatgctagagaaaaagatgagttgattcccctaaaatatggagtgattggtcaagagacaaatggtccaggtggaatgttcaaagcattaagaactattccggttatttttgaaattattaaagactgtgaagaattgtgtccaaatgcttggatcatttcttttacaaatccttctggaatcaatgctgaagcagtgtttagacatactggctggaaaaaatttattgggttatgtaatggacctgtaaatatgatcaaagacattgaaaaaattttaaaagttaaagaagaagaccatttagatgttaaaattggtggaattaatcatatgatctatgcattagatattcaattaaacggtaaaaatgctaatcgtaatttgattgatacgatgataaatgatggaaataaagaatctttaaaaaatattgttgatttaccatggagcaatgaatttttaaatagctatggttatttagggattggatatttacgctattatttacaaaaacagcaaatgctggaacattgtcaagaggatgcagctaaacatcaatgtcgtgctcaagttgtgaagaaggttgaaaaagaactatttgagaaatataaagatgaaaatttggatgtgaagcctaaggaattagaacaacgtggtggagcttattatagtgatgcagcttgcaatttaatttcttcattatacaatgataaaggagatattcaagtagttgacacactaaataatggtgcaattactaacttacctaatgatgtagtcgttgaagttagtagtattataactaaagatggacctgttcctatcccagtaggagaattaccagttcaagtagttggattaattcagcaattaaaggcatttgaaatcttaactaccaatgtggcagttagtggcaattatgatgatgccctagttgctatggcaattaatccattagttcaaagtgaaataacagctcgacaaatactcgatgaaatgttagaagcacacaagaagtatttaccacaattttttaaataaagaaatttaagtaagaataaactattagttagtttattcttatttttgtttttacctgttcaaattgaaaatttgaacatatagacttaagtcagttgagcatacgaagtatgcgaaataaaaaacatcttagatgatttaattgaagcgaataaagatttctggcctgaattgaaataagatgttaaaactatttaaaaagatactagtgtgttgatactggtatcttttttatcgttcattgaattttaaatagttttttataacgatatctttaaaatcattaaagttcttacatttttttatttctgatattacaattggttcattaaataataatactagagattcatacaatgcatgaaaatgtttgttatctattttattaaaagcaatcataaaaactacattgacaaaatgctggtttccccagtcaattcctttatgactaattaccactcctatactagttttataagcgctcattttcataggatgtggaatggcaatattcataaaagctgtagaacttgctgtttctcttttccatatctcttctttaaagttttcttctacatagcctagattaatcattcgttctgctagttcgttaataacagcggatttactaatatcttcattcattgaataaaaaagtttttcattaaaataaaaattaagattattagtaagaatttgactttttttagtgttctctattctaatgattgcatctaaaatcttatttttctcatagctcattgggaatggtggtaataatacgataaagtagtttgtagattctaaaacaggaacagtagtgataagaagatcaaaattattccctaggatctcattttcaaatgaaattgatttttgaatagttaattgatctccaaaatccatcataatttttttgtgtaaagtactagtgatatttaaatattcaggacataataggagacaggatacttttgtttcttcttttttttgtctttctatctctgttcctacatgtaaagcaatgaaggctatttcatcctcattgacgttttcatgaaatgataatgtcagctgataagcaataaacgttgagatatcatatatagttgggcatgatattttaatagaatcaagcattggatttttaagaagattgttttttattaatctatttttaaggttttttagatgtagcataaaaggagttataaaattatcggagtcaagattaataaagaaatgttcatcaacattttttatgatatttttggtaatttgaataatttcatctgatactaataaagaaacattttcgttttcatcatttatataatttgcattatttttaaagagaatatagatttcaagtatttctgatgagttaaaagagacattaaagacttgttctaaggctaggcatagttctttagctattttttcatcatttttattagtaacttgaattaattcattattgttgataatgtgattaccatggttgattcgactaaccataatagttacatgcaaaataaaattaacacaagaaaaatcgttaagatagtagtgatgctgtttgcaaatatctttgattagggtgcaggcatcatcaagatcataatctgggaaactttcttgtagcaaagttaagttaagaaaatttccgcttacttcttctgacatcacatggctaattagtttacgtttattttgttcagaacctccaacatgaagtttattattttcactagaaaaagtaattttaaaatttgcaaatgaagtattcattttataaatatctttttttaaagtactatagctaatgaataattcctcacataaatcaaaaatatcaatatagtcctgcttttctaaaagcgtcttttttatgatataaatacatctgctttcataatcctgaggaatatcgtctttatattgaagtagtgagttagcttttactttatcgatgacataaccacgattgctagaagaaatcaagctaggataattcatgtttaattcggcaatatatgatttaattgttcgaatagagagatttaatgcttttgaaagaatatttgctgtaactttttcattatgagtatataaataattgatcaattcttcttgcttccttctcatgctctcatccttccctagttgttgttttctatattataatagttttaatttttatttaaaactagaattttgcacagtgcaaaatacttatttgcactgtgcagaatgttagttgagtagatatgaacaaaatgattaaatataagcgtaaagtttaagaacttgcagacaaataagaaatggaggaaataaaaatggcacaagcacatatttatctttgttgtggaggagggctctcttcaggatttttagctcaaaaagctcgagcagctgcaaaaaaaggtaaaatagatgcaactattgaagcaaagagtgaaagcgaagtcacacaatatttgccaaaaatggatattctttgcattggaccgcattatgaatttaggctgaatgcttttaaagatatggcagccccatataatattcctgtaattgttattcctgaagaaatttattcaatgttagatggaaaagcattacttgaattagcattattagaaatagaagagttttataaataaaatatataacaggagagagaaaaatgaaaggaattatgaattggtttactaataaattagcaccagggatgcaaaaagttttcagtaatccttggattgcagcagtggcgagcgcaatgcagaaaatcttgccgtttattttggtaggatcagttatttcaatttacaatgtatttgtacgttacattccatcactaccggacttgagttttgttaatacatttagctttggaatgatgtcattgatagtagcttttatggttacttattttgggatggtggaactggatcatcctaaatatacaataactgcagggttaacttcagtgactgtatttttaatggccttatgtccaaccatggcaaccttattaaaaaatgcaacaactgggaaaactgaacttacttttacagatattaattttttaggtggatcaggtttatttattgcgattattgtaggattagttgtaatgttgattttccatttatatgcaaagttacatattttggaagatagtgctacaatgccggattttgtttgtgaatggataaataatattgttccaatgacaattatctatttaatatttggagtaactgtatttacaataggttttgatttagtagaatttattaatttaatattccagccgattgttaatttaggacaatctttactgggatttgttgttatttgttttttatacgtattgttatattcagtaggtatttcagcttggtcgttaaatgctattgttaaaccaattttaatggcgggaattgcagccaatgctgagatggcattggctggaggaagtccaatttatattgtgacaacagaaacgatttttacaacggccttaatcgcaatggggggcttaggtggaacattaccattaaattttctaatgttatttaaatgtaaatctaaaaaattaaaaacaatggggaaaatctgtattggaccgtcaatatttaatattaatgagccacttgtttatggggcgccaattgtctttaatccgttactaatgattccaatgtggataaattcaattattggtccattaattatctggtttgtaatgaaagctggtatgctaaatattccagccggagttaataatatttctcgtattcctgcgccgatttgcacctggttaactactgatgatttccgagcgtttatatggttccttgtactatttattatttatggattgatctggtatccatttttaatgagatatgataatcagcttgttaaagaagaacatgaaaaagaattattaaagaaagaattttgattaacgtaaccaattagtcatatagtgtggaggaataataaatggatgaaaatagtcttttaataccagttgcgatgaaaatcattatgaattcaggcaatgcaagaacaaaagcaaatgaagcattggaggcactcagtatctttgatttttcaaacgcacataagaaaattgtggaggcaagggaggatataaaaaaagcacatcaagaacaaacagaaataattcaaaaagaggctgcaggtgaacattataaaacatgtttattatttacccatgctcaagatactcttatgacaatcatgagtgaggttaatttgacagaaaaaatgataatattatttgaatctttttaccaaatacagggtcataaggagaattaaatatgctactaacagaaaaatacaaaaaacaaatatattatcaatttcctaaagattttttatggggcgtggcaatgagcgcaaaacaggctgagggggctgatgatagagcattgacagttgctgatttgcaaaattatgatccaaatgataaagcaaaggtgaaaggagatttatctaaagcggagattttagaccgtctcaattatccagaaagatataattttcctaaaaaaataggaattgaattttatcatcgttataaagaggatttgatattgcttaaggaaatggggattacttgttttcggttttcaataagttgggcaagagtatttccaaatggaatagatggtgaacctagtgagaaaggattaaaatattatgataaaatatttaatttgttaaaagaaatggggatagtgcctattgttacattatatcatgatgatatgccaattgatttagctttaaaatataatggttttttaaatgaaaaagttgtgacagcattcataaaatatgcaactttgattatgcaaagatataaggataaagtaacatattggatacctgttaatcagattaatttaacacgggtaggtctcagttcgttaggaattgtaaaagatacagtgacacaattggaacaaaagaaatatcaagctattcataataaatttgttgtctgtgcaaaaataaaagagattggaagtaaaataaataataactttaaatttgggtgtatgctagctgattttttagtaacaccaatgacttgtaagcctaaggatgttgttttttcaactgaaaaaaatcaaatgacaatgtatttttatgcagatgtacaattaaggggagaatatcctggatatgcaataagttattttagtcataatcatatcgccgtagagataaaagaaaccgatctagtattaataaaagaaaatactttagattttttagcgattagttattataattctaacgttgtcagtcatgaaaagaatactttagctattggcgattcccaattaaatccttatctggagactaatccatggggatggacaattaatcctcttggtctatatgattgttttcttaaatattgggatcgttatcaaaaaccattaatgattgctgaaaatggaattggtcaaattgaaaggttagataatgatacaatacacgacgattatcgaattgattatattagagaacatattattgctttgaataaagcaatcacacgaggtgtcaaggtttttgcttattgtgcctggtcgccaattgatatggtttcttcaggaacaagtgaaatgaaaaaaagatatggatttatttataatgatcaagatgattatggagtaggcagtcataaaagatataaaaaagattcatatatatggtatcaaaatgttattaaaagtaatggtttaaaattagaatagtttatataaaactatggttttttaaagaaactatagttttattttgataattaatttgaaaaagattccattgtaagatgcaattactaaagagacaggaggcgatgatcaatggattttatttttaatatcaatctaaaaaagaatttattaacaaaaatgaattaaaaccgtgtgaattgatttgtaaaggtttaacaaagatttaaagattatcgctaacagaaatattaactgaagaaagttactaaaacaatgattttgttaaaagtaggatattcaggttatgcagaatttaaatatgattgcgctaaatatgtaaatagcttaaataatgctaaagataccgttaataaagagaataataagattgaaaaaatatattgatacaatcgaattgatgcattataccttaatgataaaatgatgagaaagttagccgttttagtaaaataaacaagaagagttcgctgtgttggagaggttaatagcccgataacctgtttgcaattgatttaattgctaataaagaagatctatttttaatgatttcagttactggtaaaagcgatacaataaggtctttaaaaggttatcacagtctgcacaatataataaaccatgaaatatatttttataaatctttcgttttcgttttgaacgtacttccttgctttctaattttgcttgataaatacagaatatcttttcgtctataattacttcatgatgatgtttaaagatttttcatttctcttttggaagtttttgatactcacctctagttttgaaatattcccttttatgaagaattaaatttctaagataagttgcattcattaaaattctacacatatagggattattccatacatcagtatacttacttttatcatctatttcattctttaaactaaattcatgtaaagaaagagatggtgttggaatgtttctcttgttaaagtgtgagcaatttgtaaggtaccatagccatctccatcaatttgaaaggtatgttttacaacattagcattaactggattagtcactaattgagcgcttttttcactttacggtaccccaaaggtggtgttgaattattaatttacgtgggaattaatgcagttcaattaaatggcgagggctttattgcacgtattggtcaaggacaattactattggaatttgacatggataagatcaaggctgcgggatattcattagaaacacctgtcttaataacaaatcatactgatttaaaagagataaaaaatactaatgaagcggtggtttctaatgatgtagaattaattaaagttgaattttaaaaagatgagactatagtttttagtctcatctttttaatgacaacatttattatcgtgttcatgacaagcgtgatgaccatcatcatggtgattacaggctgtgttaggatcgtaatgcaactcaccctttagatagtcgattactgcttcatcactactgccaatgatcccaggaatgatttcgattcctaatgatgtgaggatatttcgtgcacctccgccaattccaccacaaatcaatacatcaatgttaagattttttagaatttctgctaaggctgaatgaccctgaccgttagtactttctatttgactagagataatttcttgattctcaatgtcgtatactttaaactctttactctttccaaaatgttgaaaaatattaccatcttcataagttactgctattttcattctgttatcctccatttttcttttatttttaattgtacaagatgaagtgcaattgactaagtgagctttgtcacaaagagagtagttaccaccttcaatttttaaagaatagccccggacaatgctttgagcaagcttataacgtgcttgttcataaatactctgaacggttgttcgggcaacatccatttgtttagcacattcttgttgtgtgagtccttcaagatccattaatctaattgtttcatattcgtcgattgataggactactgtttttgtagctgacgggtttggaccaaaatatgcatatctaggtaatctgcatacttttctttttcgacatggtcttggcatagcttcaccacctttattattgacatatgtcaataacattataagctaatattataaaaatagcaataattaaccactatccaatgattctttattaattttataataagtgatatactctaaacgagtaaaggaggttttaacaatgataatacgtaaagcaacaattaaagatttaaaagcaattacagctgttgaagccacttgttttccacctgcagaagcagctagtcggagtaattttaaaaaacgtttgaaaacttatccgaatcatttttggctattggaagatgaaggaaaattgattagttttattaacggaatggtaacaaatgaaacaacgatcaatgatattatgtttgaagatgctagcttacatgatgaagcaggagaatggcaggcaatttttggagtaaatacaattcctgaatatcgtcaacaagggttagctgccaaagtcatgcaggtggtaattgatgatgcccgtatggcaggacgaaaaggatgtattcttacttgcaaggataaattattgcattattatgagaagtttggatttaaaaattgtgggatttctcagtcaatgcatggtggtgctatctggtatgatatgcgtttagagtttgaacatgaatgatttagtaaatcttggtaagtttattagtttgattttacgacataaaccggaactaattggattaaagctagattatcatggatgggcaaaggttgatgagttgttgttaggaattaataatagtggtcgttttattaatcgaacattattagatgagattgtcatgacaaataataaacagcgatatcaatataatgaagatcatacaaaaattcgagctaaccaaggtcattcaatcaaagtagatattgaattaattgaaaagattccaccagaatatctttatcatggaacggcatttaaatatttgaacaagatagagcaagaagggataaaaaaaatgaaacgtttatatgttcatttatcgaaagatattgaaacagcatttaaagtcggaagtagacatggtaaagcaattgttttagttattgatacaaaggcaatgtttgaagatggctgtaaattttattattcccaaaatggtgtgtggttaactgaggacattgattataaatatgtaatggaagtaattaagtgatggttaataccattgctttttattttctatgttataataataagtatgaggtggaaaacgatgaaagaaaactttttatggggtggtgctttggctgcgagtcagtgcgaaggtgcgtataatctcgatggtaagggattaagtgttagtgatgtaatgcttgcaggaagtaagacaaaaaaacgaaaacggactgatgggattgttgctggagaatattatccaagtcatgaagcaattaatttttatcattactataaagatgatttacaatattttaaagaaatgggctttaattgtttgcgagtgtcaattgcttggtcacgtatctatcctaatggtgatgagctagagccgaatgaaaaagggttgcagttttatgatcaattatttgatgagatgttgaaactagatattgaaccagtggtcacattatcgcattatgaaatgccttattatttaagcaggcagtacaatggcttttttgatcggcggtgtgttgattattttgaacgttttgctattacatgtttcaaaagatattctgctaaagtcaaatattggctaacttttaacgagattaatggaatgatcaccaatccttatactggaggtggtgtgattgcaaaaattgataataattatttacaaaccgttttgactgcatgtcatcatatgttcttagcaggagcaaaagcggttaaagcttgtcatgagattattccttctgctcaaattggctgtatgattgccttcttatgtggttatagcgctacatgtaaacccgatgatgtaatgtttaatcataattttatggatgtaaatatgttttttaccgatgttcaggtacgagggagatattcaaataaagcattgacatggatgtcacgttatggaattgaattaccagtcatagatggtgatgaaaaaatcttagaacaaggaaaagttgattatattggttttagttattaccagagtattacgatgtcaagtgatattttagataatcttggaagtggcggaaatctttttagtggagctaaaaactcatatattaaagtaagcgaatggggctggccgattgatcctaagggacttagagtttctttgaattacttatatgatcgttatcaaattccgttatttatcgtagaaaatggactaggagcagtcgatgaaattagtgacgatcatcaaattcatgataattaccgaattgattatttgacgcaacatgttcgagaaatgaaaaaagcagtagacttagatggagttgagttgcttgggtacacttggtggagtccgattgatattgtaagctattcaactggcgaaatgaaaaaacgttatggatttatttacgtagataaagataatgatggaaatggtactttaaaacgttatattaaagattcattttatgtatatcaggaaattataagaacaaatggtgagtgtgttgatgaaaaaaaacgttatactttaaatagtcaattaaaggatgttttggaaataaaagggcttagagaaattattaaattagttagtgaaggaaaagttactgaccttcaattaaaactagggggacgcttaaaaataaatcaattacttgataaatttgatgttaatgataataatcaaagattgattatagatttactgaatcgtttagaggctaaataatgaaaatgtccggaataattaaccggacttttctatttattcaataatataagcattaatgatttggccataataagccgtgtgtaaatctttatttgctccatagaatgaactatcaacatcttgaggataaaaacgttctaaattgtttggagtaattgcatttttatcttgtacttgttgatagacaattttacattcaagtgtcaaaggaggctctttaatacctggaactgatattttatcaggatcttctaaagtaggcccaagttctttaactttatcaatatctcttcctgatttcgtaccgcaaacccctaagattttcttatcaaaagcacctaaaggaatattgattgtaaattcaggatttttttctatctgttctttagtgaaacgatgttctcttacaaaaacagtaaataattctgttgctcattcaattcctaaggttccccaggaaattgtcatactattgactttatcatcaactttagttgttaaaagaacgccagtttgaacagcttccataatttctttagcataatcaaatacatttatttgttttttcatctaattagcctccttgttattttaataactatatgataaattagaactaaattaataacaagtatacacttataagtaagatactatctaaaaggagagtaaaaatgaacgatgaagtaaatgtaagaccatttgcatatgcaatgtctttgatcgatggcaaatggaaaatgcacatattattttggttatggaaaaaacaagtactacgatatagtgagttaaaacgtgcattaggaacaattacacataaaatgctaagcactcagttaaaagaattggaaaaggacgacttgatcattcgcaatgagtatccgcaagtcccgcctaaagttgaatattcattgtctccacgtggtttaacattgatgccggtgttagaatgtttatgcaagtggggacatgaacacattaatgatggagataatcatggataaagaatattattcgataggtgagattgcagaaatttgtaatattccgatacggaccttacgttactatgatgaaatcgggctattagtccctgaaaaaagggatattgaatcaagctatcgttattacgctagacatcagatattacaagctaatattattaatcaatttaagattcaggggtattcaattaaagagattaaacatcagcttgcaaataattccgtttctttgagtgaagaaaccttgaatcaaaaacatgctgaattaaaaaaaacaatagctgaattaaataaattagagaaacgtttaggattctttttggagtgtctaaagtatcaagatcatcagttgcatttacaattaaaggaaataccggaaatttatattgcttatgttcgtcaacaaggtttagcagatcaagcagcctttatgcgtcgatttagtgaattaaatactttatgtcgtaagaataatttagagccgataggaaatataatggcgcgttattatgatgattatcagcaatatgatcccgattgtgctgatattgaagtttctattcaaattgatttaaatcatgaaattggtggagtagttagaaaagaacctggttatttatgtgtttctgctcttcattatgggccttatcgagatgaatataagacttatactcttatgatggaatggatgaaaaaaaataatttagtaatgtgtggtccagcattagaatattatttaatagatcctatctttactaatgatgaaaatgaatttgtgactgaactaagaattcctgtaaaaagcatttgactctctagttactagaggctttataataaatttgaggtgattagatgatacatttagtatatttagacaataaagaaaaagtcttagaaaagattatgagtggcaaaaaaacaatgataattcgaggagcagcaggacgcaagattcctcatagtagagtattcaatgacgaagtattatatttcatggaaaaaggaactaaaaaaataacagcaaaagcaagagtagttaacgttttaaattttattaaattaagtgaagatgaaataaatgaaatattattaaagtatcaagataaattagatttaacgccaaaacaacaagttcgctggcataaaaaatgtttgtgtttagttgaatttacagatgtagaagcaattaaaccactagattttgatcatcaggggaatatggatgattggttgattcttgatagaattgaagatgttgtagtaggaacgagtatcccctacaactataataatgctagatttaagtaaactgccggaagggtagttttttttaagaaaatttttaaggattattaataacaataaattggtaataatgatagaataagtcatattgggggtgtgaaaatgaaagataaattaaaaaactttaaacatctcttttttaaaatcctaaaatttgagattttctataaatttgcaatattcctaattatcagtccattgattaataaaattcttcaaatatatttaaataataattccagcggagctgcatttaaccaatacatattatttaatttcttaaatcttgaagggattacagttgttttaattattatgatgatggcagtaattgcaattggatatgaatttagtgtactgataaatatgattactttaaataagcaaaataaagattttcgaatttatgaggtaatgaaaacctcgttattaaatttgagttgtttaaagcatcctagcagtattttaacaggaatattctttttatttattttaccattagtgcatcttggttatataaactcattgataccaagtttaaagattcctaattttatttttggagaattgagcttaacttttcaaggaaatattttaatatgtttaatctatggattgtattttggaatttatggattaatgttttttgtaccggttttaatgattttaaaaaaagaaaatattattaaagcctttaaagaaaatataaagttccataaattattgacattaaaagaacgtatttcattaattggaataatgggtatttggatcgttcttgagaatggattaattcaaatattaccagatgctttaataaaaaatgcggattttaatcgttattttttaaagaatttaattatttcttcgagatttagaatttatttattggaatacatcatatatacattaataatcatggtcttgatgattgttttctatcaatatttaataggtgttatgggtaagcacgagcctgaactattgaaagtaaaggtggatttagaatttaatcgcttatttgaccgaactttattaaaagcacaaattcatggtaatcgtttttttcaaagcttggataaatatttttttgaaacacatttttatcaaaagtatcgtgggatgatcaaccttgttttttggccctgtatgtttatcttgattacttatctttttcctaattcaatatatattttatcagctatcttaattgttgttttgttgatgtattttgctgctagtattattattcgttatgaaaaaagaaaaaatggtcaggaatttgaagatgatagtggtttgctgtttttgccttatcgcttaattaaacgaactttaaataattctcgcttatataatcatcatcctagaatggttacagcactcttagcttttatttctgtttgtctagtaggtatgtatttagaacaaccgttgatgctccatcatccatgggtaatcggtcatcgtggttcaatttacggggttgaaaatacagatggagctatcatgacagcagctgataaaggagcggattatgcagaaattgatgtgcaattatctaaagacggggttcctgttgtgattcatgatgcagatttgtcgcgattggcacataaagatgaaaaagtaaaaaatatgactgctaaacaattaagtgaaaccttggtttatcataacgaatacactgataaaattccgacgctagatcatttgattaaaaagttaaaaaagaatagcactaaaatgggacttttgattgagttaaaagttgagggcggtaatggagaaaaactagctaaaaaaattattgatgttatagagaaaaatgattatcaaaagcaggctatctacatgtcgcttgatttagatactgttcaatatcttcaaagtcagcgtcctgaatggtggattggatattgtatttatggtagtgctggagatattgaaggatcattatggaaccaaggtatcgactttttggcgatagaagaaaatcgagctacagtgagttttgtagaaaaggctaatcgtaattgggttcctgtttatgtatggacagtagatgatgaaagtaggatgatacagtatcttgaacttggggttagtggaatcattactaattatcctaatcgggggagaaaagcagtcgataaattcaaagagaataattatcagtattattatcatcatgggtcaggatatcctgatagttaaaactagattgcgatctagtttttttctaacagttttgtaaggttggttaaattactaggctatcttaagaggcgatagtataatgaataaaaggagttgaagagaatgaaaatcatgatagttgaagatgatttgatcttggcgcgtgaattgcaattattatgtgttaagtggaattttcaggcaaagtatcttgaggattttaagcatgtagatcaagtatattgtacatatcagccggatttgattttattagatattaatttgcctttttatgatggtttttactggtgtcaaaagataagggaaaattccacagtaccaatattatttatttctagtcgagagcaaaatgctgataaaattctggcactgtcagctggaggcgatgattatattgaaaaaccatttgatttagaattgctgttggtgaaaataaaagcaatattgagaagaacttatgaatataaacatttggaaaaagaatatcttgatgaggatacctcttatgatattgtgagggggcgatttgtatatcaaaataaagttttagaattgactaaatcagaaggtaagataatgtcgacactattagggcaacgaggcaactgggtaaccagggaacagttgatgatgacattgtggaatactgatgaatttgttactgatgcgactttatcggttcatatttcacgtctacgaaataaattaaaggaattaacgaatggaaaagatattattaagacgaaaaagggagtgggttattatattgattaattatttaaaagagaaattacggcctattgtaggtggaatgttagttttagtatttattaatatttattttttatatttgtgtggtagtcgcttatatttaagtgatctggtttatttggatgttattttaatttttattgggattacgatctttatttatggaaatgtgaaataccgagcagttgaaaaaataatgaaaactaataattttttgaccacaaaggaattaaaaagctatttatcgttgcaagcacttagtgttattgagcaaaacgatttatattatcatgaagaaattaatcacttaagtactcaaatacaagaattatcggattatatttctagatggtcacatgaagctaagttgccgattgcttcaatgcgcttaatgaatgaacgtaatcaagatctagttttaaaaaaacaaatgcgtttaactattgaacaaattcaattattattaaatacaatgttaatgtctagtaagcttagaaatcctgtgaatgatattaaaatagagaaagtttttttatctcaagttattaaggaagcgataaaacatcaatcttatttcttaattaatgatcattttaaaattaatttaaaggtagagaatgagtatgtttatagtgatcggcgctggttaacatatatgctggaccagttcattaccaactcgattaaatataaacaaacagaaccaaatttgactttttatattagagaagatcatgatggattagaacttattgttgaagataatggaatcggaattgcaccggaagatgctccatatatatttgaccgtggctttatcggtcataatcttcgtgatggagactatcgctcaacgggaatgggtttatattttgttaaagagatagcagagaagttaggcattaaagttatctatgataatactttttgctcaggaagccgctttaaattacaatttgaagataatgcagaatatttcatgctagattactaaaatgtaagattatagagctaactgttagataagcgttaggattttttcttgattagttggtaaactttagttgtaatctaaggaggaattaaaaatgagaaagattgtggaaataaaaaatctcgttaaaagttatggtggtaaagattatcagactaaagtattaaaaaatattaatttagacatttatgaaaatgattttattgcaattatgggaccttctggagcaggtaaatcgactttattaaatatgttatcaactttagataaaccaactcgtggtgaaatcattattgatggtgaggatattacaaaggttaataataagcggttgtcgaaaattagacaggagaaaattggttttatttttcaagattataatttattagataatatgactttacaggataatattgctttaccgttgagtttaaatggaaagagaagccgtgaaattattgaaaagactaaacagatggcctctttatttggattaagtgaacatttaaataaatatccttatcaattatcagggggacaaaagcagcgtggtgccagtgcacgagcattgattactaatccacggattatttttgctgatgaaccgacaggagcattagattctaaatcaagtaaagatttattaatttctttgaaaaaagcgaatgagtcaggcaatgcaacgattttaatggtaactcatgatgcttatagtgccagctatgctaaacaggtttatatgcttagtgatggagcaattaaatgtcgcttaaatcatagtggtgagcgacaaaagttttatgatgaaattttaagcttactagcttcgatgggaagtgagcaagaatgagtttatttaaattagcttattcaaattttaaacgcagtgtcaaaaattatgttgctttgattatttctttatcgttttcaatttttacgttttttaattttcaaaatattgttttttctaatgcgatggatgttttaaaagaaaaaaacagtgattatattgcaattattattcaagttatttctattgttttaataatttttgtcttcttttttatctggtatgcgacaaatgtttttttatcacagcgtaaaaaagaaattggaatttttacttttatgggactggataatgtaaaaattggtaagatgtatgtaattgaagttgcgatgattggacttttatcattaattattggcctagggagtggagcgcttttttctaaactttttacaatgttgttattacgcttatcagatataagcgtggatgtttcatttagttttagtattattcctgtattactgacaatcgctttatttgtcacgatttttgctattatgattattaaaggctatattaacattttaagaagcagtgttttagatatgttatcagcatcaaaacaaaatgaattacgtgaagaaaaaataattattactttattaaaagtggtaattggggtagttttgatttgtggtggctattatgctgcgatgatggttggtgatatgtcttcgtttatctatatattttatgcagtagttttggttgttgctggaatctattttctatataatggggtaattccgtttgtaattaaaaagttagctcaaaacaaaagttatctatatcaaaaagaacgctcattgtgggtcaataatttagcatttcgtttaaaaaagaattatcgtgcttatgcaatggtaacgattttaatgatttgttcggttaccgttttagcaacctcatttgcaatgaaacaacgctacgataatatcagtcattttagaggtacttatacttatactgtgatggcaaataaagctcttgatggcaaccaaattgctcaaaaaatcagtagtaataatgagctcaactatcataatagtctaaactatattgctttaaatgcagatatggttaaaagtaaatatctatataatcagtatggtgtagtttcatatagccagttaaaaaaagccgcaaaagaagctaaaattgaatttgatataccaaaattagatgatcagcaagtagttaatttgacgagattatatttacttgatatctcagatcctgaaattaatccggtgatagaaattgcaggtgaaaaatatcaaattgttgatgaaactgcaacatcatatttaggattattgcaagaaaatattagtacctatattgttagtgataacacatatgaaaagttaagaaattttggacaagagttttatatgtataactatcaaataaaagatcctaataattatcaagcatcgattgattatttaaatagtttggtaaaagatggacctgtagattatgtgagttatttagccaatgatcctaatggtggggatattgcttgggttcgagtaatgtactctatttgtattttcttgtttttagtattcattttagctagtggaagtatcatttttatgaaattgagtaatgaggcttttgaggatcgagagagatataatgttctaaaaaaactaggaatcagtaaacgaacattgagtaggtcaattagaaatgagatacgttttgcttattattgtccttttgttttgatggtactgtcctcatatttttctgttcatgcgctagctaatgttatgaagacagaactatacactgtaaatattgttagtgctatcgttattttagtaatcttttatataatctatactatttcagtattaatgtttaaaaagaaagtattgagtgatcattaaataaaagcaggatgaagtttaatttgtcctgttattttttactaataaagcacttgcagcaagcaagaaaagaagatacaagtaaattatatttggctattgaattgtagaaataaaactaggggtttaattacataattattatatttaataattatgttgataagctattaagaaaaaacgttgaaataatagaaatatggtataattaaacatattaacttgttaggaggttaaatgatgaaaaaaaaatcaggtattattgaggaatttaagaagtttataactcgaggaaatgttatggacatggctgtaggggtcattgttggtggtgcttttacaacaatcgtaacttcacttaataatgatattatttcaccgattttagggatttttggcggagttgatttttctgatttaaaacttgtcatggggagtggtgaaaatgctccagttttaaagtatggaagttttttaacggcggtgattaatttcttaattatagcaatgattattttcttaattgttcgtgcaatgaataaaattaatgaaagtatcaaagcaaaattgactgacaaggaagaagtgctggttgaaacaacaaaagtatgcccttattgtaaagaaaaagttgcgaaagaggcaacccgctgtcctcattgtacttctattctagaagaaaaagttgattaagcaggagttgacatgaaagatattataattaaaaatgcgtatcatggtaatttaaagaatcttgatttgacgattcctcggaataaattagtcgtaatcactggtttatccgggtcaggtaaatcaactttagcaattgatgttctttatcaagaatgtcagcgacagtatttagaagcaatttcttttcaaggaattaataaaccaggagtcgaagtaataagaaatgtttcaccagcagttgtaattacacaggatgaaaaaaataataatcctcgttcttcactgggaacagtaacagatatttacactgatattcgaatgatttatgaaaagctaggagttcgtaaatgtccccactgtggtaaaatgattgatgcatcatactgtcatgaagaattagttcgagctgataatgattttactgtttatatgtactgtaattattgtcattataagatggaaaaattaacaagatcacatttttcttttaatagtgaaaaaggtgcctgtccaacttgctttggattaggtaaaacattaatacttaatttagataaagtacttgagccaaacttatctcttcgcgagggtgcagttgcattttggcatcatcgttataaagaatatcaaatcgaacaattagaaaaagtatatcgagaactggggctttcagtgactccggaaacaaaagtgattgattttaatcagcagcaaagagtgatcttattatatggaactgaatcaaaacagtttaaggaactttttggtaaaataaaaataagtaagtttgaaggaattataactaatttatggcgtcgggttgaagaaaagaaaaatcaaagtaaagaaataagcagttatttcgatgaacaggtatgttctgattgtcatggtgaaaagcttaattcattaagtcgtcaaattacagtgaataaaacagttattacagcaacaacaaaaatgcctttgacggaattactacattggcttgagcagctggaagctactgtttcaggaccacaaaaagaagctgtccaacaatatataattgatttaaaaacaaaaattcaaagaatcattaatgttggtttaggatatttgcatttagatcgtcaaacaatgactttatctggcggtgagaaacaaagaattaaattggcagcggctttacaaagtcagttaacggggataatttatatttttgatgaaccaacaatgggattacatcctaaagatacagcaggaattattaatgttttaaaggaattgcgagatcaagagaatacggtgattgtaattgaacatgatttagatgtaattaaagcagcagattatttaattgaccttggacctggtgcaggaaagcatggtggtcaaattcttgcattaggaacttatcacgagttgcaaaataatcctagttcaataactggacaatattttgttaataaaaagaaatgtaaaagagtatatcgaacaagtaatcgatattttgaggtgaaaaatgctcatgttcataatttgaaaaatattgatgtaacttttttagttgattgtttaaatgttgttaccggtgtatcagggtctggtaaaagtactttggtgtttgctgtattagctaaacagcattatcgatattttgatgatattattgctgtcagacaagaaagtattacgacgacaaggcgctctaatattgctacatatacaggaatttatgatgaaattagaaagctttttggaagtttagaagcaactaaagaaatgggttttacggctaaacatttttcttttaacagccaaggaggacgttgtgaaaattgtgaaggattaggaactgttactagcaacatgttattttttaaagatgttgaggttgtctgtccagtttgtcaaggaaaacgtttcattcctgaaatccttgcattaaaatatcatgaacattcaattgatgatgtgcttcatttatcagttgatgaaggggtcggtttttttagtgattgtcccaaaataattaaaactttaaaaatgctgcaagatgttggtttagggtatttagaattaggacaagttttaacaacgctgtcgggtggtgaaaaacagcgtttaaaattggcaacgacattactaacaaacataaataaacataatctttatttaattgatgaaccaacaattggcttacatcctctggatattgagcatttgctacttttgcttgatcgtattgttgatagtggtaatacagtagtaatcgttgaacataatcagcagattatcaatgctgctgactggatcgttgatctggggccagcgggaggaaatgatggtggttatgtaattgctgctgggacaccaaatgatataaagggtaatgagaattcaataattggtgaatttttgtaagaacttctacgaagttcttatttttatgcatattatttgcttatgcaatagctctgaggtagaataatgtcgaaatataacagtgttatattttggaggtgactatgactacacaagaaaaaattataaatgttgcgactcaggagtttttaaatagtgggtatcttggtgcatcgctaagaaaaattgccaaagcggctcatgtaacaactggagcaatgtatggatattataaaaataaagaggcactttttaatgatattgttgaagaagtgtctgaggaatttaaaaatgattatttggttgagggaattaatcttgagacgattgattacatttatcaaaattttgaagtttttaaattaatcatttgctgtagtaaaggaactcgttatgaagaatatttagattgtttagtaaatgaaaaaacgaagcaatttaatgaacatggttttgatgataaattatcacatattattaatcattcatatttatttggtgtttttgaaattgtccgtcatcaaatgactgagaaacaagctgaggattttgtcagtgatttacaagaattttatcaggcgggctggaataagttattagaaagaaaggaaatataatatggaaacattaattggaatattgattccgtttattggaacgacggcaggggcagcgtgtgtctattttatgaaaaataaaatgaacgatttagttcagaaagtattattaggatttgcttcgggagtaatgattgcagcttctgtttggtcactattgattccggcgatggatatgtcaagtgatttgggaaaaatggcgtttgttcctgcagcagtaggttttctattaggaatagcttttttgcttttacttgatcgtaatgtacctcatatgcatttggataatgaagaagagggtcctaaaagtcaattgaaaaaatcaacaatgttagtcttagcagtaactttgcataacatcccagaaggaatggcagttggagttatttttgcgggattggcatctggaagtcagggagtaacttatgcgggagctttagctttatcgctgggaattgcaattcaaaactttcctgaaggagcaattatttcaatgccgttaaaaagttctgggttatcaaagaacaaatcatttatatatgggatgctatcaggtattgttgaaccgattggtgcaggattaactattttgatggcttcattagtagtaccgattttaccatatctattagcatttgcggcaggagccatggtttatgtagttgttgaggaacttattccggaggcttcacaagggcatcatagtaatattgcaactattggttttgctattgggtttgtcgtgatgatgatgttagatgtcgccttaggttaatctttacataatcttaagcacagttgtatagtttcgtttctgtaattaagtaaaatgaggttaaagaggtgacagaaatgaaaaagagattagggttaggtttgggaatgtttttaataacaattttatctaatttgtcaggagttatggcttatagtggtaatagtaatttaccgggaagtgcaataattattgtttttgtaccggtaatgttaggaattatctatttagctagtaagggtgaggttaaataactaaaactttacatagaattaaagcagggatgatataattttaaatgagaatattagataatttagctatggtatagatggattggttataaaataatgctaagtcctttatgcacactataaaattttgattaaaagactaatcatatcttatacctgctctatttgaataactttccctatgtatatgaaagatgaggcaatagcctcatttttcatatttcataaattccaaaatttaacattttgttaacaaattgatgatattattagtctacaaaataagtattataaagataaggataaacatatatttagtaaggaggcggttttaatgaacaaattagctttagttgcgataagtttatttgtagttgtagaaattctagttggagattgcgtagtccagggaattcctctttgggtagttggtttaattggttttagcctaatttggatgggaataatttgtgtaaaagaaaaagtccaaatcaaagactggtattaaaaaaaggaaattatgatttccttttttttatttatgtttaaacatttcaaatgatgaagcaattaataaaaatagcatacctgtgtgtacccagaaaattgtataatcaagaacaccatgtaatagaataactgcaatgcatgaaattacaagggcgacataacggagatttagcttttcttgatagaccttaaataatcttttacaattatcaaacatataaggaacaagagtagcaacgccaacgacaccaaatgataaaatcggatcaagatagacgctgtgagcatgttgagtgacatgaccaccatactgtttaaaaatcatcatatatgtcattgggccttgaccaaagagcggatgggctttgattccttcaattgcagcatgccagatctttgttcttacagtaaagttatcaactagtttttcaattcttgggaactgttcaggattaaagataaaataaataccaccaatgatacaaagtagcccaattaaactgcaaatccggtaatttttattgatgatcaagaatactaacattgctccagcggttgcaacaaaagcggtacgacatccagtcatatataataaaaagaaattaaggcaggcaacgataaaataataaagctgttttttgacatttttagtaccaaatattttatatccaatcatcatgatggtaaattcaatcatcatggcatagtaattagcattgaagaaaacagaattaagacgattttcacgtctgctaaatacttttaaagtaaaatgatcataacctaaacgatcgagaatttgaatttgttcaaatagtccataaatggcccatagaatcgataatgcaattaacatatctaaaataaattcaaaagtatcttcattgatatattgtcgataatataacattagtgaaacaaagataaagataagtgcgacacatcctacaccaatccaattttgataaattaaagaaatagctaatgttaaaagcataaaaattattaaatatttagattttggggtacttttaaacgcatttataatttttttagtgtacaataggtataatgtttcaagtaataaaaaaggtacacaaatataaaatggggtagataaactaagggcggtagcaataatcattaattgttccttagtaaaacgttcttttaatgaattgataaatttcataatagacctccaagtactgttactatagcataaatataaaatagacacaaacaaaggagatataatgaaaaagtatttatatgtttttaactatcccccagaagataaagaattatgtgctttagaatttagaacattatttaaagatgaatttaagagtaaatattatttatcaaataaagattatagtgttgataaaagtgtttttgtaaaagcaaagctcgatctttggggaatagatgctgattttaataaactaatcgaaaaagtgactgcgctgcataaagattaccagaattttaaagtaatatatttaaaaaatgaagttactcatgttgactatcaagaaagtttacttaggtgtaaagatatttcttggggtattgcgggaagtgttaatatgtctagaccgcaacatactatcgcgattacaaaattagaaggtcaatggctttgcggttattatcatcatggtgttccgtcttggcaaaaacacgatgataaacctaatactttttctaattctttagatatccggttagctcgaactttagttaatttagcagctggagataatgatcaggtaacgatcgttgatccttgttgtggtatggggacagttgttctagaaggactcgctttagatttagatattgaaggattcgatatttccagggaaatatcttggcaagcacgtaaaaatttaaagtattatggttatgatgagtatttgattaataaggtgagtattcatgacttacaaaaacattacgatgttgcaatcatggatatcccatataatttatatactccaataacttacgaagaacagtgtagaatgattcagtcctcgcgaagaatttgtgacaaaatgattatggtaacttttgaggaaatgagtaaagaaataaatcaagctggctttttgatcattgacagctgcttacgtaaaaagacagaatatgttaaatttggacgctatatttatatttgtatttaataaaagcaacatttagttgcttttatttatgttttatgattttttgaagataaggtatttgtgataattcttcaacattatctttatatagaaaaagcaatgttccaaaatatataatgactccaataacgattgcaataaatagagtgataatcaaacgatcaataactttaattaaaccatagtagcatagcgcgactgtaaatgccataattgctgaactaatcaatgggtagatgaaggtgtgtaatttctcttgataataagtagtaatatgttttaaagctctttgatttgcgaaacaaagctgtaaaccataaagacagttaccgatcaatagagaataaatatttaaattcgttgcaagtaaaagaaatagagtaataaaacaatggataattaacgcatatatagcattttttaaaggaatagatgaatatcctaaagcttgcaataatccattggtataggtagaaagaccatagaaaacaattgctggactcccaaatgttaaaagggtgctggctagaacaaccgtttctttttgcggaaaaattgcttgaataatcggaactgcaagaatactcattccaacggcactgggaataaggatcaacatgatgacttttgttccttgagcaatttgttttttaacttcagcagtatctttaaatagccatgctgatgaaatattgggaattgaagctgttgacattgctgaggcaagagctacaggaacgttttgtaaaataatatactcacccccataagccccaaaggcactgatggatttggcaccatcaccacaaactagataaaacatatacatatcaatagttgagataaggttgtaaacgcaagtagccaaaattattggagtaacaatatttgaaatcattttaaagatatctttaaacgaatctgtatggggatcggctgcttcgatatttggaggatttaaataactttgtttagttcttttgaacatgaacaacatataacataagctgattagaactccggcgccagtgcctaaggcactaccagttgccccgtgactagcaactagactttgattattaaggtatggttgaataaatagataagcagctccaattgaaacaccggcattaaatacttgttcgattatttgtgaaattccagtaaaggcagtagttttaaaggcttgaaaataacccctaaaaatccccaatagtccagaaagaaagatcgttggacaaagaattcgcaaagctgaaacagctttatcaggaacaatatagggtgcaattacaaatgcgataattgctgctcctccaccaactgcaacaatataaataaatgagcaaagaagaatctttttaacattattatattgattaacggccagtttttcagataacaacttagaaatagcagttggaatactgtaagaagaaactaaaagaattagtgcatatacattataagcagtagaatagtaacccattccttgtgaaccaatcagtttagttaatggacttcgatataacagaccaataattcttactaatattccagcagcagctaaaaaagcagcctgtttaaaaattgaattctttttcataaaataaactccttatggataataatgtcatattatattaaccataccatttattgaaggataaatgtatgaaaattttaattattaataagattcttgttttaattattttattttatcataaaaagataattagttctttattgtcggtagtttaaataaaaaagataaaatatgttagaatagggtgattagaaaattaattttatatttgcttgactctccggtaaggggagcttatacgatgtttatggaaggtgataagatgttttcgattggtgagttttcaaaaatggctaaaacgactgtaaagactttgcgacattatgatgagattggattgctggcgccggcatatgtagatacttatagtaaatatcgtttttatacgagtaatcaattaataataattcatcaaattcagtcattaagacaaataggtttatcattagatgaaatacagatgattattaatggtgttgatggtgttgcaattctagaaagtcggaaaaaagcaataaaagaaagcattagtgaagcagaagatcaactttcacgcattgagtttattttatctagcaaagaggaggatacatttatgaattatcaagcaagtattaaagaattaccaggatgtaccgtatattcgaaaagaatggtagtccctgggtatgacagttattttgaattgattcctgcaataggtcaaaaagtgatgaataagtacccggacttaaaatgtacagttccagaatattgttttattatttatcgagatggtgaatataaagaaaaagatattgatattgaattttgtgaggcggttgatcaagtgaaggtagattttgatgatatcaagtttaaaaagatgccggcagttaaagcagtatctataatgcataaaggtgattatgcgggattacctaaagcatatgcgtatgcttttaaatggattgaagaaaatggatatcaggtacttgataatccccgtgagagctatattgatggaatctggaataaagaaagtaaggatgaatggctaacagaattactaataccggtgactaaatagcggattgggaattagattaaattctaattccttttatttttgtggaaagatagggtataataaatccagatttgggggttagacaatgaaattattaaaatatgttaaagagtatcgatttcccgcgataattggatttgttttcaaaattgctgaagcagccttagaattaatggttccattggtaatggctgatattattgatgtaggaattaaaaacaatgatcaaaattatattttagtaagggggttatttttggtaggattagcggtggctggttatttatttgcgttagtatgtcaatattatgcatcacttacatcacaaagtgttggaacaaaattgcgtgaagatatgtatcatcaaattaatcgttatgatcatcataatttggataaattaagtgcgcctaccttagtaactagattgattaatgatgttgtacaaattcaattggcagtagcaatgacgatccggttaacttcacgggcaccgtttattatgattggttccttgtttttagcgtttttgattagcgggccgctggcttctatttttgtagttggggctatcgttttagcaattgttatgttgatgattacaataatttcaatgccgtattttaataatgttcaaaaaaagcttgataaaattagtttgatcgttcgtgaaaacttaaatggaattagagtaattcgagcatttgcttcacaagataaagaaattaataagtttaaaacagaaactcggcaacaaaaagatatccaagtaaaagtagggagaattcaagcattattaaatccatttacatatctgattgttaatgtggctattgttttaatagtttattttggtggaactgaagtaaatgttgggggattatcgcaaggggaagttattgctctagttaattatatgaattctattttattagccttgattgtttttgctaatgtgttatcgatctacaataaagcaggtgctagttatacaaggatttttgaggttttggaaacagaaccggcagtagttaatgatggacaaatacaaatatatcgagaaagtgaagattgtattgaatttagacatgttagctttgcttatgaacaaaaaaatgttttaaatgatttgaattttacgataaaacgtggtcaaacaattggaattattggtggaacaggagctggaaaaacttctttagtaaatttaattgggcgtttttatgatgttagcagtggcgagattttaattaatggagaagcgattaaaaattatgatcttcatgctttacgttcttttattggatttgtaccacaatatgcagctcttatttcaggaacgattagagaaaatttacagttaggaaatcaaacagccaatgatcaacaattgctcaaggccttggaaattgctcagggaaaggaaatgctcgaagataaagcggctggattagatacagtaattgaacaaggcggaaagaatttatctgggggtcaaaaacaacgtttaacgattgccagagcattagttaaacagccggaaatcttaattcttgatgatagttcaagtgcacttgattatgcaactgattttaaattgagacaagcattgaaacaacttaatatgacaaaaattattatctcacaacgaacagcttcaattgaacaggcagataagataatggttttatatcatggtgacttggttggctttgatagtcatgaacagttaatgaaagattgtaagatctatcaagaaatctatgcttcacaacatagtaaggatggtgacgatcatgaatagtaagacgataaagcggttattgacatattgtcgaccatatcgtgtgattttaggtttaatatttatcttatcttttattagtgtctgtttgacattaattacgccaatcttatttggacaagcaatcgatctattaataggaataggactggttgattttagtcgtttgttttggcagcttctagtgattgtaggagttgtgcttgcgggagcattagtccaatggatcttggggcaattaactaataagattacttataatataacgaacgatcttcgtgatcgcgtctttgaaaagattcatttattaccattaaaatatattgatagtacgccacatggtgatattattggtcgagtaattaatgatattgatttgattgcagcgggtttattgcaaagttttactagtttatttactggtgttgcaacgattgttggaacaattattataatgtgtttgattaatttatcaattgcaatcgtagtgattgttttaaccccgttatcattactagtcgcttcactaatcgttaaaaggacccatatctattttaaagaacagcttgaacttcgaggtgaaatgaatggctatattgaagaaatgatagggaatcaacgaatcattaaagcctttaattatgaacaaatgaatgaagaacgttttaaagaagtaaaccaacgaatgcatgtaagtggtgtaaagtcacaattttatggagctttgatcaatccgacgacaaggattgttaatagtctggtgtatggtgcggttggagtatttggtgcaattagcgtgttaaatggtagctttacggttggtttattatctagctttttaacttatgcaaaccaatataccaaaccttttaatgaaatttcgtcagtaatgacagaaatgcaaacagctttagcagctagtcagagagtatttaatttattagacgaacctgttgaaaaaccagtcagtaatcctcaaaacgttgaaataatggaaggtaatgtttctttaaaaaatgtatactttagctatgaccctaaagtatcattaatagaaaatcttagtttagaggcattaccaggtcaaacaattgcaattgttggtaaaactggttgtggaaaaacaactctaattaatttattaatgcgcttttatgatcaaaatagtggaagtattatggttgataatgttaatacattagatatggagcgagattatttacgtcgtatgtacggaatggtattgcaagagtcatggatatttaaaggaactattaaagaaaatatagcttatggaaaaagcgatgctacagatgaacagattattgctgctgctaaaaaagcccgggttcataaatttattatgaaacaacctgaaggttatgatactatgattgatgaagatggaggaaatatttctcaagggcaaaagcaattgatttgtattgcccgaattatgttaacaaaacctccaatgctgattcttgatgaagcaacaagctcaattgatacacgtacagaattacaaatccaggaagctttcgaaacgatgatgaaaggtcgaacgacatttattgtggctcatcgtttatcgacgatcaaaaatgccgatatgatcttagtaatggataaaggacatattcttgaacagggaacgcatcaagaattgttagagaaacaaggttattattataatcttcataatagccaatttaatttagctaagtgatagatatttaataaaaaagatacaataagctaaaatgattataaactataaaggtaaagataactgctggaggtaaactttagcagtttttattattttaaaggaaattattcaaaaagtattttgtgtataaaagaagaaatagggacataaatattttatacactaaaataaaaatatatgattattatagtttagtgtataattgaacttgtaaaaattaaaagaaagcgtatacactacttataaaatatgctctagtgtattaaaaaatgatgatttatcaagtttgcgagaaataattgattattttatagttgtaattggctagagcaagtagtgtcaaaggagttagctatgaaatcaaacaaagtaaaagtatttgagttcattaaagaatattcaattactcaaagtacagatgaatatcctaaattgacaactcagtatctatccgaaaaattagacatgcaaagaactaatctaagcagtattttgaatcaattggttaaagaaggaaaaattactaaaacaactacacgtccagtactgtatcaattagcaagtttccaattgactaatcaaaaagactttgagaatttaattggttataaccaaagtttgaatgaagcagtgatgctagcaaaagctgccattctttatcctcaaggaagtcctcatattctcttaactgcagaaagtggaagtggggttaaatattttgctaaaaacgtttatgactttgcagttaaatctaaagtattaaaaaataatgcaccatttacagttttcgactgtaaaacattcattgaaaatccgacgattattaatgaaatgctttatggtgatgaagtgaatactggactagtacatcagactaatcaaggcatgctgttgattaaacatgttgaacttttatcagggtatcaaagaacaatgttattttcaatcattacaagtaataagatgccctctaatcaatatgtagaattaccgcgtaattataaatgtatcatgctttgtgcaatagccagtgatgccagtaaggatctttatgatctctatcgtaataaaatggattttgttattgaacttttgccattaagtcaaagacccttaaaagaacgatttgctcttttagaattgtttttaaaacaagaagccagaaaacttgatcgggttctagaagtaagcactaatatattacactccttattattatatgaagtgaaggacaatatccgtggtttaaaaaatgatattcatacaggagtagcaaattgttatgtaagagaacatgatgttcatcatcaccatattgagttattgttatcagattttcctaattatgttcgcaaaggaatgatttactataaaacatttaaagaagaaattgatgagattattcctggagattgtaaatttgcatttactaaaaatgaggtattaaaaaatagagcaaaggaaaataatgctaatatttatcgaacgattgatgttcgtaaaaaagagttaaaaaaacaaagtgttagtgaggaacaaattaatactttagtttcattacagcttcatcaagattttcaagaatatttaaatgaattgagtaatcgtgtaagtgataaagagcaattaagtaaaattgtttcaatgaaattaattagtttagttgaacgtttcattactcgtgtaagcagtgaactagcaataaattatcaagaaaatattctttatgggttatgtctgcatattaatgcttcactaattaaagtaagcagtaaacagcgtcttgcaaatgaagaaattaagcggatgattgatctttatcctaaacattatcatcttgctaaagaattcgttcatgaaattgaagaagaatttagggtaaagatgaatattgatgaaataatctttacaatgctgtttattttaaatgagagtaagcctgtaactaataaacatgttgttactttgattgcgatgcatggtgacagttcggctagttcgattgttaacgttgttaacgctttagcaatgcataacaatacttatgcctatgatttgcctttagataaaagcatggatgatgcctatgaagatttgaaagagcaaattataaaggttgatcagggtaaagggattattcttatttatgacatgggttcaattcgaactatggctgaatcaattgcttttgaaacaaaaatagaaattaaatatttagaaatgccagttactttaattggtgtcactagcagtaataaagccagtaataatgattcagttgatgaaatttatgaatatcttcaaacaaagtttaaagatataaaatattttagaaaacaaagtgataagaagatcttagtaataatttcaaaagagcagtcagaagttacaaggttaaagagttatttaaatgaacattttgatttaagtaatgttactgttcatgtaattgaaaatagtgaagctaatcatctatacaatgaaatcaatattattgctaatgaaggaaaaattatcggaattattggtaataatagaccaaatttagctcaatatccttttgctgaagtgagatggctagaacaaaagaatgctaaaactttagaagagatattcattgaggaagatgaagcacgtgatgatattaatgaaatatttgaatatttaaaggatcagttcaatgaggtagatgttgatggaataaaagattatctattggattttactaagagtttagaagttacactagatgcaactttagatgaggatcagcaaatcggtttaatagtacacttggtttgtttgattgatcgaatcagtagacatcaagcaccgattgttaattttattgcatcaaacataattttaaatcatggaatgttagttagtaaggtcaaggaacttttagttcctttagagatggctttaaatatatcaatcagtgacgctgaaattgcaacgattatttcaatcgttaaaaagagataaatagaaagaaggattaaatatgactaaagaagaagcaacaatggttgcctttgaaatcgtagcttactcaggggatgctcgttcaaaattattaatggctgtagagaaagctaaagcaggtgacttagtgactgctgatagattagtagcagaagctaatgaatgtttagtagatgctcataaagctcaaacagatttattgcaacaagaagctcgaggggataatgttgaggttggttttatcatggttcatggtcaagatcatctgatgacaacattattattaaaggatattgttgggactttaatggatgtatataaaaaataaaaatttaacgggggatcgtatatgaataaattagtttcaaatatagagaaattaaaacctttctttgaaaaagtttcacgtaaccgctatttacgagcgattcgtgatggtttcatttcggccatgccgattgtattattttcaagtatttttatgttacttgcatatgtaccaaatatctttggtttttactggtctaaagaaatagaagcaatgattttaaaaccatataattattcaatggggattttagctcttgttgttgcaggtactacggctaagaatttagcagataattttaatcgtgatatgccggttaatcgtcaaatcaataatatttctgcgttaatggcagcaattgttggtttcttgattgttggggtcgattcgatcgaaggcgggtttgcaaatggctatatggggtcaaaagggttattaacagcctttttagttgcctttgtcgtttgtaatgtttatcgtttttgtgtaaaacgaaatgtaactattaaaatgccagatgcagtaccaccaaatatttctcaaacctttgctgatgttataccgtttgcggtttcagcaatcatctttactatttttgatattatttttaggaatgtaactggaatatgttttgctcaaggtgtaattgaattttttcaaccactatttactgcagcagatgggtatatcgggttggctattatttatggggcaatgtcattattctggtttgtgggaattcaaggtccatcaatcgtggaaccggcagtttcggcaatctattatgtaaatatagcaaataatttagatttattccaagcgggacaacatgctaataatatattaacaccaggagttcaacaatttgttgcaacaattggtgggactggtgcaactcttgtaattacattgatgtttgcatttatgtcaaaatcaaaagaattaaaagcaattggccgtgctagttcgattccggtaatctttggggttaatgaaccaattttatttggggcaccgcttatcttaaatccaattttctttattccatttattttcgctccgattttaaatgtttggttatttaaagcttttgtagatttcttaggcatgaatagttttatgtatgtattaccttggacaacaccaggaccaattgggattgttttaggatgcggtttaggtttattaacaattctttttgctgcagttattctactagttgattttgctatttattatccattttttaaagtttatgataatgaaaagtgtgaagaagaaaagaataagaacttagatgcagttgaaaaagaagaagaaatgattgaagtagatggaaatactttaaaatcaaaacgaatcttggttttatgtgctggtggtggaacaagtggtttattagcaaatgctctagctaaaggcgctaaagaacaaaatattccattgattacagctgccggttcttatggagcacatatggatattatgaaagattatgatttagttgtattggcaccacaagtagctaattattatgaagatttgaaaaaagatacagatcgtttaggaattaaatgtgttgcttgtgaaggtaaacaatatatcaatctaacaagagatcctgatggggccttgaaatttgtgtttaaaattatggagggagaataaaaatgaaatttcctgataattttgtatttggtggtgctacagctgcttaccaatgtgaaggaagtactttgaaatatggaaaaggtaaagttgcctgggatgattatttaaaaaaagaaggacgtttttctggtgatccggcgagtgatttttatcatcaatatccgatagatttaaaattatgccgtgattatggaatcaaagggattagaatctcgattgcctggtcaagaatttttcctaatggtgttggtcaaattaatcaagaaggggtagatttttatcatcgtgtttttcaagaatgtaaaaagcagggtgttgaaccatatgttacattacatcattttgatactcctgatgctttgcataaaattggtgattttttaaatcatgaaatcatcgatcaatatactaattatgcaaaattttgttttcaagaatatcatgatgaagtaaaatattggttcacctttaatgaagtatggccaattgcagtaaatcaatacattgtaggaagttttccaccagcaattaaatatgatattcctaaagcagtttattcaatgcatcatatgatggttgcccatgcgaaagcagtattggcatttaaagagggaaaatatccaggccaaattggaattattcactctttagaaacaaaatatccttataatgataatgaagctgattatcaggcaacaaaaaatgaagatgtattagctaaccagtttgttttagatgcaactttcttaggtgaatacactgatgaaactcttacgataattaaacgattagtcgctttaaataatggagcttttagagttgatctagaagatttggaaatcatgaaaaaagctgctaagttaaatgattatctaggaattaattattatcaaagccactttattcaagcttacgatggtgagaatgatatcttccataatggaacgggggataaaggtacttcacgttttagactgaagggtgttggtgaacggatgtttaaggaaggaatcgaaagaactgactgggactggttgatttatcctcaaggactttatgatatgatcatgcgaattaaaaatcaatatcctaactataaagcaatttatatcacagaaaatggaatgggatataaggatgaatttgttggaggtaagatcgatgatacaccaaggattgattatattagaaagcacttatcatggattttaaaagcaattgatgatggtgcggatgttaaaggatattttgtttggtcgttaatggatgtattttcttggtctaatggttataataagcgttatggactattctatgttgattatgacagtcaagttagatacccaaaaaaatcagctagctggttcaagcaaattagtgaaacaaaggagttagataagattgaattataaagcaattatctttgattttaatggaacattattctttgacaatgataaacatgttttagcttggggaaaaatctccaagctgattcgtggtagggagatcagtgacgaggagttgcatgagcagtttaatggaacaccgaatgctaaaaatattcagtatatgatgaataatcaagcaacgagtgaagagcttaaaaaatattcattattaaaagaagaatattatcgtgaattttgtaagcaagataaagcatcttttcatttggtagatggagcagtagctttttttgataaattaaaagaactgggaattccttttacgattgctagtgcttcaattaaagaaaatattgatttttttgttgaatcatttaatctagataagtggattgaccctgaaatgattatctatgatgatggttcctattcaaataaagttaatatgtttaaagatgcagcacaaaaattaaaacataatgttaaagatattttagtgtttgaagattctttttcaggaattgcgaatgcatataaagcgggaattgaaaaaatcgtagtaatctgtcctcaggaaaaagaaagtgagtatcgggatttacctggcgttatcatgacgatacaagacttcagtgattttaataaattaatctaggattggctataaaagtcaatctttttgttttttaaacaattatatgtatatttattatctaaaatcctaaaaataattaaaataaaaaaattattatcttgacaaacaataatcataagagtattctatataaaacattgtataggtatatacattaaagggggaaataaaaaatgaatggattattattactggcgctttcgatggttgcattggcagcagcttatgtaatttatggtcgctatttggagaaaacttggggaatcgaccctaaggctaagacaccagcggttgctaatgaagatggggttgattttgttcctagtagcaaatgggaagtatttgcacatcagttttcatcaatcgctggagcaggacctgtaacgggaccggttatggcattgatgtttggttgggtacctacagttttatggattattgttggggggattttctttggtgctgtccaagattttggagcactttatgcatcagtaaaatcaaacggtaaatcaatgggtggtatcattgaagaatatattggtaaaactgggaagaaattatttttcttgttttgctggttatttacacttttggtaattgctgcttttgctgatatggtagcaggaacatttaatggtttttcagctgttgatggttctaaattacagccaaatgctgcagctgcatcaatttcaatgttgtatatcgttgtagcgattgcttttggtttctttttaaagaaacggcatgtaagtggcaaagcgcaagcaatgctaggaattggcttaattgttttgatgttaattggagggattgcttttccaatttatttcagtaaaacaacttggctatatgtcgtctttgtctatattttctttgcttctgttacaccaatgtggttattgaaacaacctcgtgattatttaactacgtttttatttgttggaatgatcgtggctgcagtagtcggcgtactattctataacccaactatttcactaccagcatttactggttttacaagtgagacaggcagctacatgttcccaactttgtttatcacgattgcttgtggagctgtttctggttttcattcactggtttcatcagaaacaagtagtaaacaaatcaaaaatgaaaaagatatgttacaagttggttatggttcaatgttattggaatcactattagcaatcttagttgttgtcgtagttggttctttaactcaattagttagtgacggtgttttaactgatcagctagcttcattagttactgctgaaggagctactccatttactaaattctcagtaggggtaacggcttttgtttctaaactaggattacctcaagaatggggaatttgcattatgacaatgttcgtttcagcattagctcttacatcattggatgctgttgcaagaattggacgtttatcattccaagaattatttgaagtagaaaattctcaagaagcttcagggttgaataaaattcttacaaataagtattttgcaacattaattaccttgttctttggttatttattatcattaggtggttacaataatatctggccgttattcggttcagcaaatcaattgttagcagctatggtattgatttcattatctgttttcctaaaggtgactggtcgaaaaggatttatgttatacattccaatgtgtacaatgctggtagtaactttaagttcacttggtctttctgtatataacatcgtaaatgcatggatgacaacaggaacttttgatttcttgacatcaggactacaattgatttttgcaattttattaattgctttgggagtattagttgctttctttgattttagaaaattatttaagacaaaaaaagtgtaaaaaacattgagtaatttaattactcaatgtttttattatgctattttctttttaaaatagataaaagtagttatcgtaataacagatagaatacctagatattcaaattcaacttcatctcctgtttttacagaagttgtcaaatcatcttttttatcaataactgttgtagtattgctaccattgttgacaaaaatcagttcaccagttagtagatcacgttggtagtttttaaagaaattccaaatatattgagcttctggtttatagttccagtgagcatgatctttaattgcagcaagttccattactacaccgttattgttagacaaagttcctgtatacatgtctttttcaccaagttttgtccattgctgattatccaatttaatgccataataagggtttaaatccatattcatatccgtcacggttaagtcattgattttttgatatgcttgtagggcactatatatatgtgtattactgtcttcagcccaaatactaaaaccatataattgtgaagtaccgtattgacttgaaccatcaacaggaatcatttgaaagaaatcatgatcaccacaaatatataataaaggtgtttcatgtcctttataatcattggttaattcagtgattgcttcactataaagattgacaccagaaacagccccaacccctgcaaaagtttcactattcttgacccctaataataatgactcggcaccgcctgctgataagccggtaacgtatactcgtgatctgtcgatttgtggatatttaattttcaaatcatcaattaagttaataattccttcatcccctaaaccatcgcattttgaaaaattgacactagcatcctgccattctggggatacaacgataaagttctcttttgcagctaattcaatccaaccagaagaatcggcttgaacccgaggatcattaccgtttccatgaagcgtaagaactaaaggaacagaatctttcttagtatcaattacttgattaggtaaatattcaaaccaagtgtattttccaggcatatttgagacagtttgattaatctcttgattatgaatgattccaaggcgatcaaaaattggcgtttcaattagtttatacggttgctcagcattagctaaatttgtatcagtaacaggcatattatagaactcggttgtttcattatgctgacgatagtttttagaaaaaactgtttcccaggcattatcgaatgcattttttaatgtttcatctgtttttgaatttaccacgatttgtaatggatttgtagaattttgatagatcgtgtagttgttaaatgattgagattggtcagtttgattagcttgtttgtaataactaacagctgatgttgctgttgaacttaaatatgctggtataggaacgttataagttaaatcgctattcattgtaccgccatataccatcattccagcaataaagtaacaattttgactaatataattattgacgaaagtggcaccctcatcaattccgatcactttaatgttgctgacaccagtgccggctaattttttgaaggctgtgacatcatcattgttatattgcgttgatataggattaataatatatactttccctgcccattcatgaacattatcgagaagaccaatttcttcaattaatttatcagcgctagtaagatcttgttttcccgcaaaaatgtaataaataggtgttaagatattactacgttttgaggtgtagccatctgcttcactatcatattcgtagtaagtataattattgattgtgtcactagttacttcagttaaaatgttttcatttgcatataattgattaactgaaattggagctgctaacattaatagtgacaatgttagtgctaataatgcttttgttatttttttcattgttccacccctgattttatatttataacttttaagttacattaaaattatacaagcgcttacaataataaaacataattatctttgaacgatcaattcaaaataaaactagtttattcaaaaactgaatgaactagtcgatgtaacgaatatacatatttctaaagattggaataaaataagtaagctggatataaccgctaatttcatcattacgctgattgccaaatttatagatataatcaaactttgcttcatcagtatgctgtgtaatacaggtaagaagaattttagggttattaagactgaataagatatctctaatttccttagttgaaggagcattgtaccattgaccactggtactgatacaaataattagggtatcttctttcaaagacctaagattttctgccataataatgggatcgttataactataagcattgataccatattgaaccatttctaattgaactagataaatattagccaatgaaaattcagaaccaataaaaagaacctgtttataattattgattattttaactaatctttcaagtgctgtcatatcaagcttatcaatatcattaaaagcattttgtaatgattgttttacatcatttttaatttcttcgttatttttactaataatcacttttttattattaaaagcattaagtcgcagcatttgttgtccagcaatgaaatcccaacgatactcattgatatttttataaccctgattttttataaaccggctaaccgaagcttgagacaagtaattgtcaccggctagtttttcaagactgatttcattgattttatcacgattagtaaagattgctttagcaacctgagtattagttgcattattagtagttttattaagatattgaattaaaccatgaataccttctcttttcatttttatcaccaataaaagtatagcataaaaatgaaatatttaattgtttttgaataaacattattaactaggtaatattttgggtcaataattattttgaatcaacttgattattaccagttcacaagagatagtaatttcaaaagaagagtttttaatggtctgttaaaattatttcaagtgttgatggaagcccatcatcacgttcgacgaggagcttatagttagattaatgtatttagagagcttttgatataattgtttgataagagcatcatttgagctatcataaatcatatagaacagatatttatagttcaattcatttttaaacaattcaaataaatgacgtttttaatcaatttcttttatccatgatttattatttatataaacgagaacttgtttggttaaaatagattgatttaacagattatctaaattagtatcaacaggtaattgaaatagcataggcaccatcttttatatatatgcatatacgcttagaggaaactgatgattaaagcaatgattacggcacttagaacatcactgatataatgaacaccacttaagattcgtgaacagctaacgacaaatgctagaattaacatgatcgtcccaagcagtgaatttacctgaagacaagctaatgcaattgcaaaagcactgaccgtatgtcgtgaagggaaagattcaccttgcttatgttctattaaaggatcaatagccatagcttcataagggcgtttacgattaattactttgcgcaaaagtgttacaattaaaaatgaagcaagtggcttataaagtgttttagctaataatgtattttgagtataaagtaaataaacgagcaaaattgaataaacaataaaagtaataatagggatatagcgggtaaagcccataatgattttttgcagcaagggatgtttacgaatattagataacattgtttgataaaatttttccataaaaactccttattttaattgaatgatcgtttcgcctgcattcattgttaagatgcgccgaccagcacgtttatgtttatattgcttccgaataaattgttgtagtattttacttgaatagccgtgaactacagtaatttctttcgtattgggggataatgaatttagatagttatccagccggattttagcttcaatcgtagtacagccgtgaatatcgatttgattaaacataatagtctccttaaattaaagtttagttaattatactagatactttaaaattaaacaaacttgcaatttacctggatattaagtagaatataagagcatatgaatggagtgatataaatggcactgacagccggaattgtaggattgccaaatgttgggaagtcaacattgtttaatgcaataacaaatgcccaagttgaggcagcaaactatccgtttgcaacaatcgaccctaatgttggggttgtagaagtacctgattatcgtttagataagttaacagaattagttgaacctaaaaaaactgttccaactactttcggttttactgatattgctggtcttgttaaaggggcgagtcgtggtgagggtttaggaaataaatttttagggaatattcgtgaaactgatgcaatttgtgaagttgttcgctgttttagagataaggatgtaactcatgttgatggcgatgtcgatcctattagagatattgaaacaattaatttagagttgatttttgctgatttagatactgtagaaaaaagaattggacgaattggtaaaaaagcacaatcaggggacaaagaagcgaagttagaagtcgctattttagaaaaattaaaaagtacgctagaagccaataaaccagctcgagtgatcgagtttagtaaagaagaaatggatgttgttaaacaatatactttattaacaatgaaaccaatcatttatgtggcaaatctaggtgaagaagacttagaagatccaactactaatccacattataataaagtcgttgaatttgcagctggtgaaggggctgatgttgtccctatttgtgcaaaaattgaaagtgaattagttggaatggataaagaagaaaaagatttatttttacaagatttaggaattgaagaaagcggtcttgataaattgatcaaagaagcctataaactattaggacttcgtacatactttactgctggagtacaagaagtacgagcttggacttttaaagaaggtatgacagccccagaaatggcgggaattattcatagtgatttccagagaggttttattaaagcagaaacatatagttttgatgatttagtcgaatatggcagtgaacatgctttaaaagaagctggtaagattcgtcaggaaggaaaacaatatgttggtcaagatggtgacatcatgttgtttaaatttaatgtctaatggcaaaaacaaaaaagagttttattgagagaataaaaccgactggagctaaagatttaattagaaaaattattttattagtttgtatttgtgtattttgttatagtgcgtataatctagcctcaatttttcttgaatataagagcatggatgatagtaataaagaagtagaagaaacatatgttactgaaaatacagaacaaaaaaattcatataagacaattgattttgaagccttattagcaagaaattcagatgttaagggatggatcgatattcctgatactaaagttagttatccaattgttcaaggagaaactaatgatacatatattcatagtgatattgacaaaaaggaatttagagccggttcaatttttattgcaagtgaaaataaaaacccttttactgatttaaatactgttatttatggtcataatatgaaaaatggttcaatgtttaataacattaaatcatatacagaacaagattttgcagataaacacccgtatgtttatatttatttaccagatgggacagtaagtcgttataaagtagtagcagcacatattattccagaagagagtttattatataatactggaattactgatattcaagctttttatcaagagatgttaaaaactagtgatattaaggttgattttgaacaagctgcaggtaatccggtaattactttatcaacatgtacttcagctggtagtgaaagcggaaaacgtaatgttgttcatacagtcttggatagagcaggaattgatcctaaaacggaaacaatggattaatttagacttgtggaaaatcacaagtctttttatatataatttttgcaatataaacttttatagtaaattagttatgaatggcacttgataagaagtagataattaacatatttttcttttttattacatagatttatagattataatatctatatacgtccgaatcaaagaaaaaaagggattaatttgacgaataaagttattttatgtatgataggtaaaactgttatagttgggagcaagaatatgaaagaaaaaatactcaaatttattacatcgaagttttttgtcttaggaattcaattattagctacgattgcagtagtctactttacattcaaactggatttagtgccgactaagtatttaattgctggaattgtggtattagcgttgttattagcaggattctttggaattatttatagtagtgaacaaaaaatcaaaaaaggattatcgagtaaacgaggaatagttactaaaattattagtttattgataagtatcattttgattgctggctgtacttatatttcaagagggaataattttattgaaaatgtttctaatgccactggacaagaatatgttgtttcagtgatttcattaaagaatggtaaaattactaaattaaaagatcttgatagttccaaaaaaattggagtatcttatgaaaaggatactgttacgattgctgaagccttaaaagatcttgataccgagattggtgatcatgaatatactaagtatgataattatgcttcacttgcagatgctctttatgagggaaaagtagatgcaattgttgttggtgaacaatatcgaacgatgctgcagacaaatcatgaagaatttaatgatgttactaaggttttaaaatcatatgcttatgatgcgaaaatggaagtaacgactaaacaaacagatgttactgaaaatgctttttcaatttatgttacaggaattgatgtttatggaagtttaaaaacagtatcacgtagtgatgtaaatttaattgttacggtaaatcccaaaacaaaacaaattttgatgacaagtatacctcgtgattgtcaaattaacttgcataaaaatggaaaaatggataaattaacacatactggtatatatggaacaagtgaaacaattaatacaattcaagatttattggaaatgaaaattaattattttgcacgtactaattttagtggtatgactaatattgttgatgctttaggcggaattacagttaattcaagtgaggcttttgaaactttgcatggtaattatcaaatcactgaaggtttgaatgagatggatggtgataaagcattgtgtttcgttcgagaaagaaaaagattaaaacgtggtgattttgctcgtggtgaaaatcagcaaaaggttttaaaggcaatgcttgataaagctatgtcacctaagattattactaattttaataatattttaagtgcagttgaaggctgctttgaaacagatatgtcagataaagagattaagtcattgataaatatgcaattaaatgatatggcggattggaagatcatcaatgttcaaattgaaggtgagtatcaattaatggatgatactttttcaatgaaagggactaatagtgatgttatgattccttttgaatcacatattgaaagagtacgagaattgatcaataaagtcgaagaaggtaaagaaattaaagatagtgaattaaaaggattaactcattaaataagaggagctctttcgagctcctttgttgttttatttttttataataatggtataataagagtattaaattggagatagaagaaaatggtttttaatcgaaagtattataaattatgttttattatatatatgtttatcaatactttagcattgggctatttaggtattgagacgaactacctgtttgtgccattattgatttgggcattagtaataattgtgcatgatatttataaaaaaagtttaaattaaaaaagaattacagtctgctaatgatcgttcaaggactgattttattgcttgctacagcgaggaatgactatagtgatttaaattcctatgttattgcagtaatgcaattagttatttatttattgatttttaataatcctgtttcaatgagcaaagatgatattgaagatgaagtacgaatgattattccactagtaaatgtattagttggtggagcttcacttatctctattggaatgtatttagtgcatttttctagtttagctaacggctggactttaggaatggtcgggaatcgtttgtttggaatttattttaatagtaatccagctgcttttttagcgtgtattacgattgttttagcgttagtcgcagtaaggcagaagtttaagggaaaatactggtatcttgcgaatattgggattcagctggtatatattcttttaacaagatgtcgtgcggcattaattattttagcaatcattatcgtcatggttggatattattttttaatacgtcgtaagccgtatagtaattttaagagattagggctggcaattagtctaattgtagttattgctggtgcaagtctagtaggtcagcgggtagttgagattgttccacagatgcagggaattgcttctaaggagacaagtcgttttcaaatggataaagttgttaaggcgggacatttattaattgctgggaattggcaagattttaatcaaggattgacaattatcgatgaggtttctaatggacgggtatcattaactaaagctgctttagaaatttggcatacggaaccagttattggaattggagcaaataattttaaaaaaataggcagtcaggaaacagatgcattggagtattgggcagttcaagttgttcatagtcataatgtttttttagaggcgttagtaactactggggtaattgggtttatattatttgttgtatttttctttaagacacttttaatgatttttaatgttttgaaaaaaagtcacggcaaagaaatatactttattgttcaaatgttcgttatgatcgttttaagtgaatttattggtagtttatctgattatggggtattctatatttattctttatcagctacattagcatggtgctttttagggtatttatacacatatcaaaatattacagaaataagtaatattgataagatttaaaggctattttggtagccttttttaattgcgcaagaatggtgcaagatgaaattaactaatgtgctatgcttagagcaggggaagtaaataagaatgaacaatgaagagcaaattaataaagtaatagattatattgaagaacatctacaggatgaaaatttaacacttactacgattgcacaggaaattggctacttaaaatatcatttgtatcgaatgtttactatgattgcaggaattacaatttatcaatagcttcaacgacgtcgttttaatgaggcagcgcggatgcttgtttatgaggatattgcattgattagtggttatgatactcaacgttcattttctaaaagttttaaagcattgtttaaaatgagtcctagcagttatcgaaagcaacaaaagttattgctggtgcaactaaaattagaacttaggtcagttgggttccaattatttaactgatgaacattgtactggcaggccgatgttctttttcttttgaattatttaattgataatattgtagattataaggggtaaaaataaaaattgtttaaaaataaaagcataaacgttgacatctttcgacattggtatataatgttagcaacctaacaataggaggggaaatagtgaaagaaaagcggatcggaatagaaattaggattcttgcgaacttgatttgccggtgtttaaatgaattgggttttaatgaagagcacaatggtttaactggacctcaagggttagttttagggtatttgtatgatcatcaagataaagatatttttcaaaaagatatcgaagcaactttcaatattcgccgttcaacagcaacgggtttattacaatgcttagaaggtaatggttttgtaaaacgggtaagtgttgattatgacgcacgattaaaaaagatcgttctcacgaccaaagcacatgagttcaaagagttattagaatcacatattcaaaaaatggaagaaattttggttaaagatttagaaccgcaagaggtcgatgacttaatcagaataattggtaagattaagaaaaatttagagtaggagaacaaaatggaaaagaagtattacatgggaattgacgttgggtcaactacgataaaaatttatattacggatcaggatgataattgtatctattcaaaatatgagcgacattattctgatatccaagcaacaattaaaacattaatcaatgatgttaaagaacaatttggtaatttagaagtaacggctgtgatgacaggttcaggggggttatcactttcttcatgtctagatgttaaatttgttcaagaagtaattgcctgcacaaaaacaattgaaacttatattcctgaatgtgatgttgcaattgaacttggtggagaggatgctaaaataacttattttcaaggttcactggaacaaagaatgaatggaacttgtgcagggggaactggagcttttattgaccagatggcatcattacttcaaactgatgctggaggattgaatgaattagcgaaaaattatcaaatgatttatccaattgcttcacgttgtggagtatttgcgaaaactgatgtacagcctctaattaacgaaggggcaaacaaagaggatattgcgatttcaatttttcaagcagtagtcaatcagacgatcagtggtcttgcctgtggtaaaccaatccgtggtaaagtagcttttttaggggggccgttatattttttagatcaattaagacaacgttttattgaaaccttaaatttacaagatgacgaaattatttttcctgataattctcaactgtttgttgccatgggagctactctattagcgaaagaagaagaaaagccaacaacgattgaagcgttgattgagaaattagataatattgatgaaacaatgcttgctagcgaagatacactagacccactatttgctgatgaaaatgatcgaaatgagtttagacatcgtcattatattaataaagttcgaaaaaatgatattaaggggtatgtcgggaatgtgtatttaggtttagatgttggttctacaacaactaaagcggtattgatcgatgataatgattctttattatactctttctatgattcaaatgaaggtaatccgctagatgtggtagtaaaaatagtcaaagatatttatgattttattcctcctaatgttaaattagttcgtagtggagtcactggttatggtgaagcattaatcaaggcggctcttaaagttgatatgagtgaagtggaaacgatggctcattataaggctgctacttattttaaagaagatgtaagtttcattttagatattggtggtcaagatatgaaagcaatcaagatcaaggatggaattattcaagatattttattaaatgaggcttgttcaagtggatgtggttcatttattgagacttttgctaaatccttaggatacgaggtgagtgattttgcaaagctggcattagagtcaaaagcgccaatcgacttaggaagtcgttgtactgtatttatgaactcaaaagtaaaacaagcccaaaaagaaggggcaaaagttgaagatattagtgctggtttatcatattcagtaatcaaaaatgctctatataaagtaattaaattaagaagtaaagaagaactaggggacagtattttagtccaggggggaactttttataatgaggcagtattaagagcgttcgaaaaagaagctggtgttaatgccattcgtccagatattgctggattgatgggagcttttgggattgcccgtttagcccgagaaagttaccaaggagaaccgacaaccttattaactaaggatgaattagaaaatttcacttgtcaaagtgaaattagatattgtgaaaaatgtactaaccactgtatgttgaccgtatctacatttaatgataatagtgagtatattagtggtaaccgttgtgagcgtggagccaatataccagtttcatcaaagaaattaccaaatttatttgattacaaatatcgtcgtgtctttaactatcgttcactaactgaagatcaggctgtgcgtgggactgtgggaattcctcgagtattgaatatgtatgaaaattatccgttttggcatactttctttactaaattaggatttagagtaattctttctcctcgctcatctaaagcaatttatgaaaagggcattgaatcaattccatcagaaagtgtttgttacccagctaaattagcacatgggcatattgaagctttgattgagaaaggtataaaatatattttctatccaagtctagcttatgaacgtaaagaatttaataatgctaataatcattataattgtccggtcgttacttcatatccagaagtaattcgtaataatgttgataatctggagaatcgcagtattatctatcgaaatccatttatggacctaagcaatcgaaaaactttattcaataacttaaaggatgaattgcgggcatttaatgttaacgacaaagaattattgagtgcaattaatgatgcttatgatgaattagctaaatgtcggcaagatattcaagatcaaggagaaatggttttacaatatcttaaagataataagatgacaggaattgttttatctggacgtccatatcatgttgatccggaaatcaaccatggattagctgatttgattacagctgagggcatggcagttcttagtgaagatagtgtttgccacttagataaggatttagatcaattgcgagtagtcgatcaatggacatatcactcaagattgtatcgggctgcttcatttgtagcaactcagcctaatttagagttgattcaattgacttcatttggttgtgggctagatgctgtgactagtgatcaagttgctgatattttaaaagctcgtcataaaatctatactttgattaaaattgatgaggggagcaatcttggggcaattagaatccgaattcgttcattaaaagcaacgattgaaaaacaagctaaaaacaaaaaacagctctatccaaaatatcagcccttaaaagtaccttttactaaagagatgcgtgatcaaggttatactattttatgcccgcagatgtcacctttacatttccaatttgtagagacagcaatgcaggagtctggttataatttagtggttttaccatcagttgataaaggggcagttgatgctggtttaaaatatgttaataatgatgcttgttatccaagtattttagttacgggtcaaattatggaagctttattgagtggtaagtatgatttagaaaagactgctgtaattatatcgcaaactggcggaggatgccgtgctactaattatatcgcctttatccgtaaagcattgcaagatgcaggaatgcctcaagtacctgttatttctgccaatcttcaaggtttggaaaataatcctggatttaaattaactttgccactaattaaaaaggtagtaattggggcaatgtacggtgatattttcatgcgagtattatatcgagttcgaccttatgaagtaattccaggaagtgcaaatgatttatatcaatcatgggttgaacgatgtcaagaaaatgtaaaaaatggaagtattaaacaatttagaaaaaatgtttatcaaattgttaaagaatttgatgaattaccactattagatataaaaaaaccacgggttggtttagttggtgaaatcttagtaaaatttcatccaactgcaaataatgaaattgtagaaataattgaacgtgaaggtggcgaagcagtaatgcctgatttaatagatttcttccaatattgtttctataatactgattttgaaaatgaacattttcatgcttctaaaaattctgcacgaatttgtaatttagcaattaagtttgttgatttacttcgtcatgatatgatcaaagctttaaagaaatctaatcgttttgatcctcctgcatcaatccaacatttagctaaaaaagctagttcgattgtttcgattggaaatcagacgggagaaggatggttcttaacgggtgagatgattgaactaattgaatcaggagctcctaatattgtttgtatgcagccattcggatgtttgccaaaccatgttacgggtaaaggggcaattaaagctttacgcaaagcttatcctgaaagtaatatcgtggcaatagactatgatcctggtgcaagtgaggttaatcaattaaatcgtattaaattaatgctttcaactgcatttaagaacatgaataaaaaaccagagtaatctggtttttttgtactattttacgtatatacggatattgtacacaaatacacttgattcgttgacattgataactttattttctaaaatacatatataagaactaagttcgtatatatgaaaggagaaggaaaatgaaaatttcagattcattaactgaaaaattattagttgtagcaagcaagattagtaatcaaaaacatatgtatgcaattaaaacagcttttacaacactgatgccggtaattattactggagctttttgtacgttgattgttaatgtagtttgttcgacggaaacaacagggattagtttagcaaaggtgcaagggttttcttggctggaaatgttcactgatctatttaatgcagcaaattatgctactttaaatttctttacaattgcagctgtcgttttaattggattagagctgggagttaaaaatggaataaaagggtttatgacgggaatagtagcggtttgtagttttgttgcatgcttaagtacaaatattgtagctacagtaggagaagagtcaattacggttgctggaattgccaaagattatacggcttctaaaggattgtttttgggaatgattattgcactgttttcggtagaactatttacaaaattatgtaaaagtaaatatttgaagattaatatgccagattcagtaccttcaaatgtaacaagcagttttaataacttatttccatttgcattgacaattattatctttgcagcgattaactatacagtggttcaattagcgggactaagtttatatgatatcatctatacttttattcaaaaaccattgcaggcagtagtacaagggttaccaggagtcttattgttaatgttagtagcacaaattttctggtgtgtaggtattcatggtaatcaaattattaaaccagtaagggacccgttattgaatgcagcaattttagctaatacggatattgttgcaaatccgaactataatccggctgatcttaatattatttctatgtcgttttgggatacttatggtaatattggtggttcaggttgtgttgttggtttgttgattgcatgtttagtcttctcaaaacgtgaagattataaacaagtagctaagttgtctattgctccaaatattttcaatatttctgaaactttgcattttggtttaccaattatgcttaatccattattgatgattccttttattattaccccattagcaacaatggcatttggatatttcatgacgattattggattctcagatatattagtatatgctttcccttggacaaccccgccatttattaatgcctggatagcttcaggtggcagtattggaacagtaattacccaagcactatgtattgttatttccattgctatttatactccatttgttattatcgctaataaacaaaaggatattgtttcacaatagaaggctgaagccgcattagcggcttttcgtacatacattagagaaggaaaattaaatgaaacttaatcgtacagccttaagaacaattaaaattcttgaatatatagctaatcaaaaagatggatgtactttgttagaaataacagaagctttagatatacctaaatcaagtgcttttgatattgttaagacattactgtataaaaaaatgattgtcgaggatcaaaatcatgggaaattaaaatataaaatgggaataaatgcttttattattggaagcgggaatattgagcgcttagatcttgtagaagcagccaaaaatcaattgatagaaactgctaatcattttaatgcaacggcatttcttgctatcttagataacaaaatggttacatatttatataagtatgaagcgccacatcgtatagtcactaatgctaatattggtacgagaaaaccaatctatagtacggcactaggaaaatgtttgttagcttttcaaagaaaaccagaagttattaaagatattttaaaagaaattgattttaaaccgttaacagaatatacgattactagccctcaaaagtatcttaaagaattaaaaagggttaaaaatatcggatatgcggttgattttcaggaagattctatttatcaaatttgtatagcagcacctatttttaatcacaataaaaatgtcgttgctgcaataagctgcacttttttatatgatactaatttaagaattaaagagattggtgaagaaatgaaaaggatagcactgactatttctaaaaagttaggttatatagatgatacaggcaggaggaatattcatggcaagtaaagtaaaaaagaaacaaaatttgcaaggtttaacagaacaacaaaaacatattataaaattgcggaatgaattaaacaaacctgatccccatcaagttaaggcttttacactatataaaattataacttatgtttttaatgttttatttccgccatatgcattatatagaatctggtgtaagaaatcggaattcacaaaaatagaacgctatgcccaatcagttgttgcagtgacaattttatgtatgtttgttttattgcagttagaaagatataaaattatttaatgggaaatcgttatcaatttataaaatcaagtaaagaatgttgacctccactacaaaagaaattatagtataaatagacgatattacgaattaaattcgtaattataaacttgctaaaaattaattggtatatactaaattgatggcaatggagatggaggaaaaaatgaagctaaatcgtacattattaagagcaatagaaatattagaattactttcaagaagtaaagaagggtatactttaacggagctatcattaatatttgattatccaaagtcaagtgtttttgatatcatcaaaacattagtatataaaaatatggttgttgaagataatcaaaccggtattacaaaatataagattgggttagcatcgtttcttattggaagtagttatttaaataatatagatattgtaaatatagctaaaagtaatttaattgatttcgcaaacaagatgaatgcaacaacttttatggctgttttagatgagaatatggtgacttatatttataaatatgagtcagaaaacagtattattacaacagctaatgttggtacaagaaaatcacttcattgtgcagcattaggaaaagctatgttagcttataaaagcgaagaggaaattaataaaatcattgataagattgattttatttcatatacgtattttacaatcaaaactaaagagaaacttattgaagaattagcagaggtaaggcaacggggctatgcaaaagatgatcgagaaaacactctgcaacaaatagctgtggctgcaccactttttgatcatgaaggacatgttgttgctgccatcagttgtgttggtttttatgaaagtagtatcgatttagatgatttaggattacttattaaagatgtgggtaaacagatttcctataaattaggctataatcctcagtaaggaaggagttggtaattatgaaaatgacatttcgctggtatggaacggatgatcctgtaagtttagaatatattaaacaaattcctaatatcacaggaattgtgagtgcagtatatgatataccggtcggagaagtatggccgattgaaaagattgaaaagctaaaagccgaagtaaatttagttggcttagagctggaagttattgaaagtgttccggtgcatgaggatattaaattaaagagaaatgattatcaaaggtatatagataattataaacaaacaattagaaatcttgctaaatgcggaattaaatgcatttgttataattttatgcctgtttttgattggactagatcttctgttgatcatcaattaaatgatggttcgaaagcattagtctattacaaaaatgaagttgctcaattagacccaacgaaactatctttaccgggttgggatacttcttattcagtaatggaagtgagtgaattaattacagcatacaaagagttgggtgaggaaggattatgggaaaatcttaaatattttataaaagagatcttaccagttgctgttgagtgtgatgttaacatggccattcatcccgatgatccgccttggtctatttttgagattccacgtattattacaaatgaaaaaaatttagatagatttttatcgttatatgatgatagccatcatggcttaacgttgtgcagtggatcattagggtgtgcttcttttaatgatattccgttgttaattagaaaatatggaaaaatgagaagaattcattttgcacatattagaaatgtaaaaatattagatgatggttcttttgaagaaagtgcccactattcaagatgtgggtctttagatatggtggaaattatgcgtgcatatattgaagtaggttttgaaggatatataagaccggatcatggtcgaatgatatggggagaaactggtaaaccgggatatggtttatacgatagaggtttgggggctatgtatcttggggggattattgatgctttgaaagatgacggcgacttataattacacaggatattctaacgagtagagttacctgctctccttatcgtgctctgtagtataccacctctctttcattatagcagggggataggaagagtagaaagaactagaatgttttcaagaaatatttgtgtccatgcgcgtagcgtggggaaatggagaaaaatatgaaaaaaacagtaaaattaccagagaattttttcttaggtgcagctgcaagtgcttggcagacagaaggctggagtgagaaaaaggagtctcaggattcttatatagatttatggtataaggaaaataaaaatgtttggcataatggttatggtcctgcggtagcgactgactattatcatcgctataaggaagatattgcttatatgaaagagattggcatgaattgttataggacatcgttaaactggtcacgatttttaacggattatgaaaatattgtagttgacgaagaatatgcgaattactatgataaaatgctggatgaattgattgctcaaggaattgaaccgatggtatgtttggaacattatgaaatacctgctgaattatttaaaaaatatgatggatttgcaagtaaacgtgtggtggaattatttgtgaaatatgctcaagaagcatttaagcgctatagtcataaagtaaaatattggtttgcttttaatgaaccggtcgtagttcaaactagaatccatcttgatgcactaagatatcctttttatcaagatagtaaagcttggatgcaatggaattataataaagctttagcgacaaatatgattatgaaagtttataaagagggtggatatcggattgccggtgggaagtttggtactattattaatgtggagacagcttatccaagagggaattctcctcgtgatttagaggcggctgataaatatgacttattttataatcgtatttttttagatccagcaatcttaggtcactatgaagagggtttctttgatttattgaagaagcatgatattttaatggaatatacccaagaagaacttgagattattcaaaataatactttggattgggtgggaattaatttatatcatccaaatcgagtaaaaggaagaacaacgatagttcatccagaagcaccatttcatccagatttttattatgaagaatttaatatgccaggaaagaaaatgaatcctcatcgaggctgggaaatctatccacaaatcatgtatgatatggccatgagaatgaagaatgattatcataatttcgaatggtttgttgccgaaagtggtatgggggtagagaatgaaaagcaatacaaaaatgaatctggtatgattcaagatgattatcgtattgaatttatctctatgcatttggattggctgcttagaggagttacagaaggctctaactgtaaaggatatatgctatgggcatttactgataatgtttcgccaatgaatgcttttaaaaatagatatggcttagttgaaattgatttagaagacaaccgaaatagacgtttaaagaaatcagcttatttctataaagaaattatagaaaaacgtagttttgaaatagaaacagatgaagaggtttataaatagttctgattttttctaagttatcagaattgaaaatacttgaagtgataaaggagaaggttatgggatttccaaagggttttttatggggtggagcaatcgctgctaaccaggctgaaggagcttatcttgaggatggcaaagggttaacgaccgttgatatgattccgcatggtgaaaagcgaatgtatgtaaaattaggtgacatgtatcctgttaagttaatagatggtgagaattatcctagccatgaggcaattgatttttatcatcgttatcaagaagatattaaactatttgcggaaatgggctttaaaacttttcgtacaagtattgcatgggctagaatttttcctcatggcgatgatgaacagcctaatgaagctggaatttcattctatcttgatttatttaaggaatgtcaaaaatacgggattgaaccattagttactttgtgccattttgatgtaccgatggggctagttgaaaaatacgggtcatggagaagtagagaaatgattgagtgctttataaggtatgcaagagtatgttttgaaagatttgatggtttagttaaatactggttaacatttaatgaaatcaatattttattacattcaccattttctggagctggaatagcatttaaaccagatgaaaatcatgaacaagtaaaatatcaagcagctcatcatgaactagttgcttcggcactggcaacaaaaatagctcatgaaataaaccctttaaatagagtaggctgtatgttagcaggaggacaattttatccatatagttgtgatcctaaagatgtttggctagcaatgaataaagatcgcgaaaatttaatgtttatcgatgttcaagccagaggatattatccaagttatgctaaaaaggtgtttaaagaaaaagatattaacatagaaatccaaactgatgacttggaaatattgaaaaaatatcctgtggattttatttcatttagttattatcagtcacgctgcgctagtgctgatcctagtcgtggtatgacggatggtaatgtagtaaagtctgttaaaaatccatatttagaaacttctgattggggctggcaaattgatcctttgggcttgagaattactttgaattatttgtatgatcgttatcaaaagccgttatttattgtagaaaatggattaggtgccaaagatactattgaagaagatggttctattctggatgactatcgaattgattatttgagaaaacatattaaggcaatgaaagatgcgattgatgacggtgttgatttaattggttatacgacttggggctgtatagatttagttgctgcttcaacgggagaaatgagtaaacgatacggttttatttatgttgataaagatgatcaaggtaatggaacgctagaaagaagaaagaaaaaatcttttaattggtataagcaggtaattgctagtaatggtgaaagattagattaaatatatttaaaagggtctgtgaagggctctttttaattacttgatttaaaagtattggcataatatgagacataattttaattcgcagataatgtatagtagtgagataatcttaaagagaagaatttaattagtttaatatactaaaatagaatgttatttgagaccaaaggggaatggattatgaatagtgcagattttttcagttagcgaaaagaaatatttttcatttatttatgcgatgtaatgagcaaagtgattttaagtatatccctaactatgcaccgtctgttattgcggaatttaatgataatcatttaataatcaaagactttaatactagaaaagatttctatgagttttgtcagtgtaaaatagatttatggaaagaaaattataatattttagatcctaagcttggtgatttaattgaaaattcgtttgtgtgatttaaataaaccattaaaaattagagaaatatctctagctttttaattaaataaaatgctctcttctaaacaacaagattatttgttctttaaaagggagcatatcacgtataagtttaaaagagtattataatcaactagttgaatctcgtcgaataacttcgactggcaaaataaattgctttttttcatcattgatagcaatatcattcattaaatctaaaagtaaactacaagctgttttagttaaagcaggaatgttctgcttgattgttgaaagtgatgggtggctggatgcagaaatgaaaatatcatcaaaaccaatgatcttaacttcatcagggactttaacattgttttctaaaagtcctacaagtaccccataagcacgccaatcattagttgcaaagacaccatcaaaaggaatattgtttttaattaattgattaattgcttctttagccccttcgtaattagcttgttcaatatccaataataattctagctgtttgttttcttgtaattgataatcttttaaagcttgacgatagcccattaaacgctgcttgttgacagataatgacttatttcgtgatacgattgcaatatttttacacccttgttgaattagttcttcagttgctaaatatccccctaaatagtgattagattcaacatagtaggcattactatgatctttgggttttcgatcaatacaaacaattgggatgtcacgagttaatgaatctgatgggattgtttcaattcctgaaatgcagatgattccgtccactaatttagaatctagtgatttgaaataagcaacttctttttcttcattttgtgaggtattacaaataaatactgaataattgtgtttaaaaaaatagttttcgatatctaatgctaactgtgaaaaccattcattatcgatgtttggaacaattaatccgattgtttttgattttgatgtccgtaagcttttggcggcaatattagcagtataaccatattctttaataattgtttcgaccttctctttagttttatcagaaaagcggccattattgttgataactctagaaacagtggcgacagagacatcagctaacttagctatttccttaattgaaatattttttttctttaccatttttgttcccctccattttcattatagattaaaaaatagatattttcaataaaatgtaatcgcttactcacaaagaaaaaggtgaataaatacaacggcacatattgtgccatggatatatgtggaaacgtttactcaagatatatataataggagtatgaacgaaaggtaaacgtttactcaaaatataggaggattgtatggagaaactattatgtccatcaatgatgtgtgctaattttggcaatcttgaaaaggaaataaaagagttagaagaaggtgggattgatttttttcatctagatgttatggatggtagctatgttccaaattttgggatgggtctgcaagatattgagtatatatgtaaacaagcaacgaaaccatgtgatgtgcatctaatggtcgtcaacccaagtgattatattgagaaattcgcagctttaggcgtaaagattatttatattcatccagagactgataagcatgcttgccgaacattacaaaagattaaagatgctggagcaaaagcaggaattgctttgaatccgggaacatcttttgaaacagttaaagaacttttgtatttatgtgattatgtcatgctaatgagtgttaacccaggttttgcaggacaaaaatatttagattttgtcactccaaaattccggcagtttgttgatgctgcctctaactatggcggctatcaggtaatgatcgatggtgcttgttcaccagaaaaaatcgcgatgttatcaaaggtaggcgttaaaggatttattttaggaactagtgcgttgtttggcaaagaaaaaagttataaagagattattacagaattaagaaagttataaaggaggaaggataaaatgaatattttgttagtatgtgcagctggaatgtcaacaagtctacttgtaaatcgaatgaacgaagcggctgcagcaaaaggaatcgggattaatattgaagcacatccagttgggagtatcgatcaatttggagatgctgcagatgtgattttattaggcccacaggtgcgttatgaattaaagaatgttaaggctaaatatccaaataagccggttgaagttattaatatgcaagattatggaatgatgaatggtaataaggttttggatactgctttaaaattgattgaaaggtaataagattaaattaaaataaattttaggaggtttattatgagttttccaaaaggttttttatggggtggttcaattagtgctgctcaaattgaaggtggttggaatgaaggtggaaaatcaccagtattagtagattattgcacagctggttcagctaaagaacgtcgtcaaatttggtatttagaccaagagggtaaaaaagtacataaagactgggaagcagttgatgaattaccagaagggtgtaagtttcagttatttgatgatttacattatactaaccatgtggctagtgatttttatcatcgttataaagaagatattgccttgttagcagaaatgggatatacaacatttaatacatctatatcatgggctcgtatttatcctcatggtattaaggggggtgttaatcaagaaggcgttgaattctatcgtagtgtttttgaagaatgtagaaagtatggtatggatccagttattacactgtataaatatgatgaaccggtttctcttcttgaacaacacggtggttggcgcaatcgggcaatgattgatgaatttgttgaatttgcacgagtttgttttactgaatataaagatttggtaaataaatggatgacatttaatgaaattaatatcattatgccattaaatgatactcctaaagataaagctaaaagagatctagcttatttgcacaatcaattggttgcggctgctagggcaactattgttgctcatgaaattgataaagatcttaaagttggtgcaatgatttgtggaaatatgaattatccacttactcctgatccaaaagatgcatttgcacaatataaacgtttccaagatttctttggatatagtgcagatactcaaataaggggagaatatccaccttatgctaaaagaatttgggaagagtggaattttactccagaaattacagaacaagataaaaaggatttaaaagaaggaaaagcagactttttaggattttcttattatgcttcgggggtaattactactcataatgaagaacaattggatattactggaggaaacattttaggaagtgttaaaaatccgtatcttgaagcaaatgcttggggttggcaaattgatccgttaggatttaaacatttcttgcacattttaaatgatcgttatcaagtaccgttatttgatgttgaaaatggtattggactgattgaaactgagggtgaagatggtatttgtcatgattcggcaagaattgattatcatcgtcgacatattcaatgcatgaaagaagcagtcgaagaaggtgtaaacctatttggttatacaacttggggatgtatcgacttagtaagtgcgggtaccgggcaaatggataaaaaatatggatttatctatgttgatatggatgatcaaggaaatggtgatctacatcgctcaagaaaagattcattctattggtataagaaggtaattgccagcaatggtgaagatctagattagagtcaggagaaagttatgaaaattggaattggaaatgatcatgttgcggttgaatataaaaatgtgatcagagagtatattgaagcaaaatatggctatgaagtaatcaattatggtactgataggttgagctactagcgcatcgttcacttacaacgcctatctatattaacacatcttattagcttttgcaagatttattcttttaagaaatggtgcccagggccggaatcgaaccggcacggattttaaggtccgcaggattttaagtcctgtgcgtctaccagtttcgccacctgggcaacacattaatggaggttccaaccggactcgaaccgatgataacagagttgcagtctgttgccttaccaacttggccatggaaccattaacttgttgttcttgtttttatcagtcggtgtcatcaccagactgctcatttattatatgttaaacagaaaataatttcaagtattttttataaaaaaattaccattttcttatatataagaaaaaacacactaaaaaagattcattttatcaataatttttatatttatatttttaaaaaaactgctgatttttaatcaacagttttaactattttgctttcactttcgtccagcgagaattatacatctcttttacagcattatcctgataagcaaatacttcatcattcgggccagtgcgcagtccataagcactaatatctttaaactcctctttttcagcctgagccgctgcattaacatttgcagttaaatatcctacttcgacagtattcttataagatactttatcacttatcatataattaataaattcatttgcaagttttgtttgcttgcactctttcgaaataacaaatccatcaaaccagacattagtcccttctttcggcatatagtaacccatattaggattttccgacattactgctgctgcatcaccagaatacattatcgccatcgccttaacaccactgatcattgtatcaattgactcatcacctacataaaccggattcatttcttcacgttgctctaacagccactgataagcttcatttatttcacgttcttttgtagtattcattgaatatcctaaagctttgagagcaaccataaaactatcacgctctgaatcatacatataaatttgatttttgtattttgtgttccgtaagatactccatcctgcttctaaatctttttcatctacaacagttttatcatataaaatacctacattaccacaaaaatacggtacccaataattattactcaaatcgaatgactgtcctaaaattccttcattaatattatccaaattaggaattaatgatttatcaacaggctgtaataaatcctctttgatcattcgttcaatcatatattctgaaggaactagtacatcataactatttccactcatatatttagtgtacataatttcatttgaatcaaacgtttcataaataatccgacaatcgaacttatcttcaaaatcactaataactgttttatcaatatactctccccaattatacactcgtaacgttttacgactgacaccagtagaaattgaccacactacagataaaactagacaaacagcaataactatcttagcagttttactgcttaatagtttatttgtcgcttttggaaagaatttcggcactaatgttccaattgccacaaaaagtaatacaacaactaatataatagtcgcaagtgcataaatactaggattagttcgctttgacatattgtaaataacgatcgaaatattttcaattccattcccgctaacaaaataagaaataataaaatcatcaaatgacatagtaaaagccaataaagcccctgaaattattcccggtttgatctgagggataattacttttgtaagagcctgaaatggagttgcccccaaatccatcgcagcatcggctaaattaacatctaactgtcgtacctttggtaaaacatttgtaattacaaatggagtacaaaaagctacatgagctaataacatagttaaatagcccttttctactttaataaacgaaaacaacaacatcaaggatatcccggtaactatatcagggttcattattggtaaattatttacttgtaaaactaacttacgtaataatggttttgactttgatactccaattgctgtgatcgttcccaaaactgttgaaataacggttgaaaggattgcgatactaactgacacaacaatagcatcgatcatttgttgatttacaaataactcttgataccagcgtaatgaaaaaccactccagcttgaaagtgatttagaatcattgaacgaaaaaattgccataatcacaagcggtaaatacaagaacgctaaagcaaaaccaatccataaactactattaaaattaaacttaaagttttttagttttttcacgtttagcctcctcttgataccccgcgtatttttcaacccggttaataagtcccatgaggacaataactaaaacagctaaaatcaaagaaacagcactaccaaaatgccaatcccctacattaataaattgctgttcaataaaattaccaattagagagtactgtccaccccctaacaattttggaattacaaatgaggaaatagctggtaaaaataccattgtaattcctgttaatactccacctaatgacaatctaaaagtaattttccaaaaagtagtaatcggattcgctcctagatcattgcttgcctcaactaaagatttatccattttagttaaagcggtatgaataggtaaaatcataaatggtaagaaatcataaaccattcctaaaacaacggcaaagtccgtatataaaaagctaacttcaccaaatcctagaaattggacaaaattactgatgattcccttactactcaatatattgatccacgcatatgttcgcatcaacatattgatccaagttggaaacgtaatcaataaaataagaagtgtctgcgttttttctttacaccttgaaattgcataagccactggatatccaattgccaagcataaaaccgttgtaattgcacctaaaacaaacgatttgactaatactgaaacaaaaattggatcaaaaaatttagaaaaattttctaatgtaaaattaaatgtagtaatcgtatttcctttttgaacaaaggcatagatcataattaaaagcattggtacaactgtcaaaacaaacagccaaaaacaatatgggccaaccaacttacgaaactgtttcattaatagctacccattttatccataacatgaatatcttcaggccaaaaatccaaattaacttttttccctacttcactaatatctgttgtgtgtaccatataatcacgatcttttgtctctacaataatctcgtaatgaacgcctttaaaaacaatagaagttacaaccccttctatttttcctttaccaacttcaacaatatctaaatcttctggtctcaaaacaatatcaacatcttgaccatcatcaaaacctttatcaacacattcaaattgctttccatcaaattcaactaagtaatcttttacaaaaatcccttcaataatatttgattctcctataaattgagctacaaaacgattttcaggttcattataaatatcgattggtgttccaatttgttgaatttgtccctcattcataactacgatcgtatctgacatcgttagagcttcctcttgatcatgagtaacataaacaaaagtaattcctacttcctgctgaatattttttaattctatttgcatcgttttacgcatttttaaatccaaggctcccaaaggttcatccaataacaacactttaggctcatttactaaagctcgtgcaatcgctactcgctgctgctgtccacctgataactgatttatatttctttgtccaaagccagctaacccaactaaatcaagcatccgattaactttatgcttaattgtttctttgtccattttttttatttttaaaccaaaagcaatattatcaaaaacatccatatgaggaaataacgcatatttctgaaaaactgtatttagttctcttttatacggcggtaacccactaatatcttgaccatcaaataaaacagttccaccattagcttcttcaaaaccacccataattcttaaagttgtagtcttaccgcaaccacttggtccaagtaaagttacaaattctttttcattaatttctaaatgaataccttttaaaacaacttgaccattatattcttttgttagattgtctaattcaattaattttgtcataatgtctcctttaaaataatggtggtgttgaaacccaaataaccttagccttagtttccccaggattaaataaataatgcgatactaatcccttcaaatagaaagtttctccttttttcaacacaaattcattatcaccataaatcaacttaacccgtccttgaacaacatacccaaattcctgtccttcatgaggagcaattatcattgactgtttatctttttctaattcaattaaaattggttccatatcatttttttgagcgttaggaataatatatgaaattttataatcatcttgaatattttcaaaaaaatcatcttgtttaaaaactagttgttccgcttctttttcactaaagaactcttgcagattagttcccaaagcttctaaaatatcttctaaagtagcaaccgaaggtgatgtcaaatcccgttctaattgcgatagaaagccttttgttaattcactgcgattggctagttcttctaaagttaaaccattagcttgccgtaatctttttaccttactcccgatatccataagacacctccatcatttattcttttcaacagtctaattataacgaatcttgtcaataaagcaactatcatttaacaatttgtttaatatattatacttaatagcaaaaaaataataggcctagacctattatttctctaatttttcccgtcgtaacgaagatttaataaataaatcttttagtaatcgttcgtcattatcttttaaagccactttaattaagtctagttgttcttcaaatgcttcaattgaagccaacaaataatcactatttcgtaaaaataactctgaccataaattttcattaatatttgcaattcgagttaaatcacggtatgaatctcctatgtacttaccagtttcatatttttcattatcactattaatcaaagacactgcaattgcatgtggcaactgtgatgtaaatgaaataatttcatcatgagcttgtggcgacatgattttaacactcttaaaacctaaagttccaacaaaacgttccataaaactaatgcattctttttgattaaccggatgttcaatcagtatataattagcatttttaaaaacttctttactagcgtacccatatccttttttctctcgtccagccattggatgtccactaacaaattcaacttcaggatcaataattgtcattgcttcttctaagaaataagatttaatccctaccgcatcagtaatgatacttccttttttaaatttattctctttaataaattttaaaaccaatgaaggatataaacatataatagttaagtcagattgtgcaataatttcttttccatctgtaaatccctcaattatagttccttcatttttcgccatttgtaaagtcttttcatcgatatcaatcccataaacttcatgaccttgaccttttaaggctttaacaaaactgcctccaactactccgagacctactactgtaataatcataaagacctcctcgattatttaattatctggtcttaccttatatgtaatattattctcagtaaaagtaagctccataaaattataatatttcttacactttaaactaaaaatactgcaatcaatgacgttgcccctaaaagcaatgccataaaacaataacgaataaacaaagcgcttagtggcggtttctcttccttattgataaaatagaatgttaaaactactaacaaactagtcaataccccatgccctaaaataaaggcagttttagcatcatagtatttcattaataaaggaatgaaagctaaacttacagccaaaaaatctaaaactatataaatcactgttcgtaaatttatctttatccaccgaaaactaaaattttctttaaattcagtcatcttagattttttagttttttctttatgataaaaatcaaattcctttttttgtctttcaaccttacgatcaaatcttgccacttttattcctccattaactactttcttttttcttctaacatcttaattttataatctaacagtttttttgttaaatcaacatagtaatcatgagggtattctaagcggaacacttcatcccacaaacgtgctttttgttgattagaatattcacgaatttcttctacagtatattcggggtatacccgtttaccattaataaagactggtacttgtaactcttctacactgtatgtattagcagctattgtcttaaatttccaaatattcgattgatgatatattgttaaatcgtgactactggaaatctcttcatcatgaaaagcaattacatcaccaattgcttttcctgtttcattttcgaataagcgatatacttttttatatcctggattcgttattttttccgtattttcagaaattttgattttaggaataatttttccatttttttccagagccactaacttatatacaccaccaaaaactggcgcactccgtgaaacaataaggttttcacccaccccaaatgaatccagctgggctccttgatccaataaagaacgaatcaaatattcatctaatgaatttgatgctgttatcttagcatcaactaatcccgcaacatcaagcatcactcgcgctcgctttgataaataagcaatgtcaccactgtctaagcggatgccttttaattttttacctaacggcgctaaaacttcatttgctacttttatagcattaggcacaccactttttaatgtatcatatgtatcaactaataatacacaatcatccggatatgtaagagcatacgctttaaaagcttcaaattcactttcaaatgattgaacaaatgaatgagccattgttcctactacaggaatattaaacatcatccccgcagaaactgtagctgtcccggcaactccaccaatataagcagctcgagctccatatgtagcactatcatagccttgagctcgccttgccccaaattctaaaaccggtcgtccttttgcttctcgaacaatgcggttagcttttgtagcaatcaatgattgatggtttacagttaccaataataaagtttcaattaattgtgcttctataaattttgcacgaattgtaattaaaggttcattagggaaaaccggtgtaccttctttaaccgcatatattgaccctgtaaaatgaaaatctcgtaaataatcaaaaaattcttcatcaaacttatttagtgagcggagatatttaatatctccctcactaaaatgtaggtgttcgatacattcaatcaactgctgaagaccagcaaatattgagaatccaccattatctggatttttacgataatacatatcaaaatacacatattcatctttattgccttgtttaaaataattataagacattgttaattcatatagatccattaccaatgttaaattacgtttacttcctgcatgtaaatccatctattgttctccttgtatatatttatcattataataaacttttttcttataaaaatctagttattttagaaatatagttcataagactgtcttggttgtggttgcggctgtggtaatggctgtggcttcattggtggcattttttcaaatagtactggaactaataattgttgcccaggatagatcatcattttatcatctaggctattcatatttttaatatagtcaactcgtgtattaaatcgtcgtgcaattgcataaacgttatcaccacgatttacagtatatagaaagatatcacctacctttggtgcaactgttggcattggtcgccgatcaaacaaattatccatgtaatcttcgtacatgtacatccctcctaccataacctattcaaataaaaaaataataaataggcaaaaaaacagacttcataaaaaagtccgttatcttgctaatttatttaatgcatctttagctgcctgttgctctgctcttttcttcgaagaacctactccaacccctaataccatctcatccattttaacagccatttcgaatactggattatttgacggtcctgatgatgagattagatcataagttaccgtctttctctgatcagcctgaatcaattcctgcaattttgttttaaaatctgtaatttcatcgtaattaacatcctcaacatgcttatagatcgtaatatccagcattttttcaacatattctggtccacagtcatgacatatcgcacccataaaagcttcaaaaatatcggctaaaacactatcacgatcacgcccaccattattcaactcacctgctcctaaataaataagcgggcctagatcaagttctctagcaaaacgtgctaatgattcttcacgaacaagttttgctctaagtttggttaaacggccttctggcaattccgggtataaatcaaagatatgccgagaaacatgatactgtaaaaccgcatcacctaaaaactccaaccgttcataatcatgatttttcattttattttcatttgcatatgaaggatgcgtaaaagcttccttaaatatttctatattctgataaggtatttccattttttgtaaaaattgttctaattccacgttaattcaatccttctttcattttttccacaacgtcactagaaaccatttcaaaagctaagttaattgcattttcaaaagcaattgcatcacttgaaccatgggctttaataaccggtttaacaaaacccatcattaaagcaccacctgctgccttagtatcaaatttagtcaataactgttttaaagccggcttagcaagaaccgctcctgccttggttctagttgatgacataaaaccatcttttaaacttttaaccagcacttttgcaacaccttcaattgtctttaatgctacattacctgtaaagccatccgttacgacaacatcaacttcaccatccaaaatctctttaccttcaatattaccaacaaaattaatttcttgcatatcttctaacaatttatatgtttcttgatgaatctcatcacctttatgatgttcacttccaatatttaataaagcaattttagggttggtaatttttaaaacatttttagcataagcgttacccatgattgcaaatgatttcaactgttcagctgtattttctgaatttgccccaacgtcaagcattgctactttattatcactgtaagtaggcatcattgccatcaaacaagatttttcaacaccttcaatacgttttaaaaataacattgcacttgcataataggcaccagtatttccacaagataagactgcatcaacttcgcccttacgagccagcatcattgttttaaccatacttgattcctttttacgacgaatggctaaaatattttctgtcatttccagaacttctcgcgcatcgatcaaagtcacttgatcatatggttttaatgcttctaattcctcaatctttcccacaacatataattcatctgttttatttttctctaaaaatgatagacatgcttccacaactattctgcttcctaaatcaccactcatggcatcaattcctaatttcatctacttcacctcatattagtcataattataacataaattaatcaatatatttattattgttgattaattgttcttcgatttcttttattaattttaaatatattaaatcattagatttgctttcaagcagttctaatgcatcctttctagaaatttctaaaatattggcatcttcgaaaatatttccaacactaaacaccggtaatccactttgttgatttccaagtatatcccccggtccgcgcaattttaaatcatagtaagaaacttcaaaaccatcatgacaatttcttaaaaattctaaacgttcccatgcctcttgacttgaagaattacttaataaaaaacaatatccctgctgatcactacgaccaacacgaccacgcagctgatgaatctgactcaatccaaatcgctcagcattgtaaataacaatccaatttgcattacttacatctaccccaacctcaattacagttgttgaaactaagatttgaatctcattagctttaaatgctgccatgatctgatcctttgtttcatcgtccattttaccatgaagcagaccaatttgatactgttctttaaaataggccttcatcccattatatattcccgtagcatccctgctatcgatagcttcactttcttcaaccagagggcagacaacataacattgtcctccacttgctaaatactctttcaaacggtttaaaataggtttcatactatgtgtcttaaaaacttctgtaattactggttttcttccacttggcatcgttttaatagttgatacatccatatccccatatatacttatggccagtgttcgaggaatcggagttgctgacataaccataaaatctacttgtttacctttttcttttagtgctttacgttgatttactccaaaacgatgttgttcatctgtaataactaaaccaagtttttgataaattactttttcttgaaataacgcatgtgttccaaccacaatatcaatagtcccgttttctaaatcattatagattctttgtttttctttatttgataaatgtcctgttaacaaagcaatattgatatctatttttttaaataatttgattaatgaacgataatgctgagtagctaatatttctgttggcgccatcattgctccttgatatccagctaaataatttgcatataaaccaattgctccaaccactgttttaccacttccaacgtctccttgaacaaagcgatacatcattgtttctttttgtaaatcattaattacttccaacgctgcttgttcttgatcaaaagtcaattcaaaaggcaattgggcaataaactcatctagagtttggcgattaaattgcttttttattcccaaattatctttcctagataatttaatgtattgcatagttaattgaaaacgtaaaaattcctcatattttagataacgtaacgcctcttttacatcatcattattactaggaaaatgaattaaattcaatgctaattctttatggattaaatgatgtttaattaataaattagtaggaacctcgtcttgaatatgaccatgataaaaatttaatgccttttttacataaccttgaaaagatttttgagtaattccttcttttaatgagtatattggtgtaatcccactgatttcatcaagtggttttaatcgtaaatcactagcagtgatactttttgttttactattatatttaccaataatggtcaaaggcatttctttagtcatattttttttcaaaaaatgacgattaaataaaattactttataaacctcctgcttatataatatttgaaaagataatctagataagcgccccttataaaatattttaggctcatcaattaaaacaccttcaataataactttttcgttatctattaaaggtgtttcttcaatcgattcataacgataagggaaatgtaaaacaagatcgcgaactgaatagatattcatattatttaataattcaatacgatttgtatttatttttaattgttgtaacggtatttgtttagtcatattatcaccacgaacattgtatattatttaaacaaaaatatctactattatacaaaaagcattaataaaacaactaagactccaatcccaattaaaattgataaagaattggctacagcagctacttctccttcatatttacactgtcttgtaaagactgcagatactgtactgatcggtgcagctaaagcaataattaaaatctttttagcaagcagcggcaatggtaataagaagaagcacaaagccattaataacatatttcctaaaagacggtatgataaaatagagattaaatccttgaagtcatcatgtgaaattttaatttctaataacagtccaatcatcagcattgctaaaaaaccatttccagcgccaataaaatcagtgattgataaaattggagctggtatttttattttaaataatgctaaaaagaaaataacaatatatacatcaaaaggaattgatgaaaataatttttttattacattgcttacggataacttctgttcactactaacaacacttgaagcaatcgcaaaggttccccctaatcccattaacgcatttccaacatcaaacatacataaataagctacacccattcctgggaaaaaagcttgaacaaacggtaaaacaaaattaccaatattgtagcccgaacaattgatcatatacgctgctcttgttggtgccgatttcccgttactaacaaaatacccaattgcaaccattaaaacgtttaaaataatccccattaaaattaaaacaatcatagcaccattgatcgtaattccattagcattagaaaaaagtgcacatggcaatgtaacattcataataattgttgccaaagtataaccgtcttccttttttaatattctaaattgttttaataaaaaaccgataactattacaattacaaaacctaaagcctttattaacacatcaaacatatttattcccctttttatatgataagacaatcataactactttttaaactttttttattcttttttcaaaatataaaaaaataagttattcaatcgaataacttatttattgatcatttcaattgcttgttctaaaacagcttgcccatccattttagaaaagttaacaccatcaattgaagcaaccggaatagaactattaacgatacctttaaccttttcaagatctccagcattttgaggagcaactaaaatacaatcagcatcagcccaagataagtcgattgcgctttcagcaactgcccaaatcatcacatctatgttcttttcttttgcatcttttttcattgcatttacaagcatactagtagttaaaccagatgcacagcatagcaaaattttatacataaatatacctccataaacatttatcatttacatatgaaacgattttatcacaatgaaattaaaattactacaattttcagaatttaaaaataaattttgacataaaacgattcactgtttattttatgaaaaaatatagtaaaatatcccctattttagttcaattgataaaattctttctaaatgtaaagctaaataaccaatttctgattgtggaatctcttttttcattacctttgataaacgaatacaaatttctttagaacgttcatatgcaaaaggaaatctttcttgggtaaaatcactaatatccatttgtaatttttcttcagtattaagacgtaataataaatatttaatgtgattcatcagtcgaatataagagattgaattacgatcaattacaatattcaattcttttcgtaatttatcaatactctcatgaattatttccattgcctgcatcgattcgccaacatgatcagtactaatggctgaatgaacatgtaatgttatataaccaacttcatcttcagttatttcgaaaccagtaattgaattgattaattgtttaccttttaatgccaccttatattcttctggaaatagtaattcaatatctttggtaaacggattagacatattaacattttcttgaattcttttaattgcaaaatcaatatgatcggctaacggcaataaaatctttgtatctacgtgatcaaattgttcttgagcaaatctaattatatcggatgcgatttcaataaaaacgggatcaacattcctgataatctcgtgtggcaaccttttttcctgttcttttgtttccatcttatactttttaactccatcacctggaatataaatatcgtttatctttttaccaaaaccaatacccttacctaaaaaaataacttcctgattatctttacttgctaaaatactattattatttaacactttttctattcgatacatgattatcccttcccatcttatccgttttccttaagcagcaaaatcattttgtgtttcacatgtttatcaccattataaacttactataatctaacttgatttatattactcttacctaattaaaccttatttagcttttctaaatattcttctaatttcatttttaggtttgatgccttaggccaaagaccagctggatatttaattcccgataaataattcctataacacctgatttctttagtatattttcatctatctttgcaagatcattaacaaacctattatttcaactatccaaatatttaaagttattctttccacccagtccttttacaatataataaaattgctgattaaaaccatctataactttactggctgttaaaacatcaaaatttttctcatcttgctgcaatagcaacttaccgttattactacgtcccaatgtttttaagttatattttagaattaaatatttaaaactactataatataaaagaaaataaataatccccactggaattattagcagccaatttgttttggcgttcccctgcaatatcccgaatataattaaatcaagttaatcctactgtaatattcaaaatatgtgcagcaagataagcactttccgccaaaatacttgcatcccaaataacattggtgccataaaaataaaagaaaattcaattgattctgtgattcctgttaatatacacattaatgccgcagtcagcaatattctacataccaacttttttattgtgaatcggcacattgatatatcgctagagccacatcaggtagtccaaatatcataaatataaaccctcctgaaaaatagcgcgtagctgctacactaaaatggagtatgttaggatcagctagttgggcaaagaaaatattctgtccaccttgaactaataaaccatcaataagcatactcccgcctactgcagtttgccaaaatggtagacaaaatacatgatgcagtccaaagggaactaataaacgctttattacaccaaaaataaaagtccctaaatatccagtttcatttaccaaacttcccagtgtataaataatactttaaatctgcggtcaaatcacatacattataattcccataataataaaaatcgaaagaatcggtgtgaattttaatttttcaatacaggatacacatttagaaagcttagttcggtaaaaaaatgattatgcaagtacgctaccgtcgttccaacaactattccgccaaaaatttccatttctaaagtcggaattacgcatattaccgtaatcgtaccctttaaaacattattactatcgaattatcagctaagatttgaccgttaattaccaataacacattaattaatgcatacattacaaagaaagcaatcaccgacgataaaaccgtaactgctctttctctttttgccattcccaaagccattccagctgcaaaaataaaagatagattatcaatgattcctaaacccgcttttttcattataacaagtagagcatttattatcgtcacctcgcctaaaatcttctacaaattatatgaagtgatcattgtttcatttgcaaaagcaattgctaatcctaacaccgatctcgtaactggtagaactgctattgataacataaaacttcgttcgattctttgtaacagcgcaaaaattcgctctttcattctttcctccgaatccaacgaaacccactttctctatggtatcattgaaagtgccttcggtcaataaattgtattgaatcaaaaacattttttacattctaaaaacacacgaatctaatcgtgtgtttttatcctcacagcattaattgtgtttttttcttttacctgctaatgctaatgcacctcctgtaagacctaataaaacagcatagcctatagtttcaatgctatctccagttttaggactagtgccttcattatccgttattttaattttaacaagtgcattcaatgcctcatttaatttagcagctgctatgtcaaccatatcttgcgttgcatttttatcatcatatacagctctaccgttttctaaagcaattactaaaccctgataagaatctttagtatactcagattctttgattaattctgctttttttatagcttctaataataactctttatttatatttacttcaatatttacattaggaatatcgaatcctgtttgtgatgttgtattagtagaagttaatgtattttgatatagcagatagaaagcggaagcactccagctaaaattcttagtatgtagcccttttcccgtttcagggttataattttcatggattggtcctgttcctaacaagcctttagcatgatcaaataatttcgttgttgccactttcgcttcatcataatagccgtaattttgtaaagcttctaccgcatatagagcttgatctagccatactggtccacgccaatatttttctggtgcatatttattattatcttttgaagctgttgggaaaggtacaaatgtatcaaacttattagcatctgtcatactttctacaactcgtgcagctttatctttagtcgctgctttagcccatagtgggatccatccttcagttcctttaccccgattcactaataatttcttttctgaaccatcttcatttgtttgaacatcataatagaatccagtttcttcatcgtacattctatcattaatatattcttgaatatattgtgcctcttgtgtatattttactacatcattttgataccccaattcttctgccattgatttcaagaaacctttttcagcatataaataagcatttaaatccactgattcttgattaataacatatccaattggcgcatgttgattatttcttactgtataaatttcaatgcctttatcatctgtcccgtttccttcacggtcaaaacgtgttgcattatccattccactttcccaagcagccgcttcaattccagcttctgggcatacaatacgttccccattatcatctaaaatataaccgtcttcattaactgtaccaaacccttcaacatactgaccaactgtatattcataattacgccaatcataacatgtttcatgcaccattccaccatattcagcaataccatttttatcaatatcacgatttgtataccaccagttatgataagcagctaatttgggatacatttcttttaaaaactctttatcaccagtttgacgataaacattttcaactgcccatgctgctaaagctggtttagaatttcgttcattccagttaccgccatcaccaccgcgatcttcattttgattatagaaaatacagtcaatgatagctcctgcatcttgagggcgtactgcatcatcacttttaatttgataatcaaataaagcacgaacattatctttagctaattcttcattaaaatatgttgtagctactacttgtttccaagaatcccatgcccacataccgatgaaccatttatatgacattgatggaacgattccatcatgtttgattgctccagcagcagaaaaccagttagtcatcaatgtttctattgattttactgcagcccgttgataattaacattagcatctactccattttcaaaaatagtatctacatatccttgccaacgagaattatttttctcgaaatatttttgaggattttttaataaattagttactttagttttttctgaaactctttcttcatttgtgaaagtaaaactttgtgtttgataagtattatattcgctatcagctccaatcgttattgattcatttttggtaattgtatatgataaccgatcatcacttaccgttgttttaatatcatcttcacttaatactacatcaaatgagttttcagttgttgtcatatattcccaagtgcctcttttttcaatgaagttaactttcaccccatctgcactttcactcaaagtagttcccatacttttattttcactagtataccaagtaaataaatgtccatcccaagataaatttaattttaaatcatcattagttttattaattatttttgtttcgatcaaagcacttcggttagtaccaaaaattaattttaattttaatgttaactcagccaaatcataagtttgttcaagacgacctggataatatacctcattagtagtcgctttagttaaatcaattttttcatttccttgtgctgttactttttctaaattaattttattaattgaatcagataaattaattggatattcttctgcaatgattactggtccagcaaatcccccatatagatctgttgctgttttttgatgtagatagtaaccatgccaagctcccatatctgaaaagttattatattcatttgtactatatgtcccgtagattttttcttttggatcggcagttacatctaaaacatttccaaaatcagtaaggggttttgtattctcagctgctcttgtaatcgttattgtagagcccaacatcatgcatgacaatcctaaaatcagtccttttttcatgatacctctttttttcattctcatcgattttctcctccatataaaactgtaaaaagatgtatgctataggataaagatgaacgcgcgctttttcatcaaaaaaggcatcaacatatactaaaaaaatatataaagataaaaaatatcttaatataaatctagtatagttgatgcctgcattaccagttacacactatttcaatttttacaaactaaatactatcattgtaaacggttactgtcaacccttttagtgaaaattgtttttatcccaaaacatttccttgtttttaaaataatcatcacctcgacaaaatatactgcgtccaactattttgccaaaacatttggcactctttttagcaacttcaaaactcattggtgcaaaatactgttcatcgattctttcatctgggcaataatccaagagattcccctcaaaataaatattgtctttaaaaatagtaagtagatcatcgggtttataataatatcccggggcactgaatttaaaaccgatttggcttaacacatggataacaaattcaacacatgtatatgattgatatgtagcaaatccctttgttaccgggtaagtaagaaccgaaaaaaggttatataaatattcttcattaccatacaactccccaataatctcattagctaatttatattgttctaaactaaccggaatttttataattgcaacatcaacaaatgtttcttttcttaatgtatagcgaggaattgtttcaaggacaatcccggctaaaaataatgaattatgctgtagacgagcaaatgaatataacgcttgaagattttcatctaatgcgatggcactatgattatagcgaatccttccaacttttctaatcatgtaaccaaatcttgttggtgttttggaaaccattaaatataaattttttgttttatccatcgttagattcccttcaatattttttatcttaatattataaccataccatatattttaaatatcgacaaattttgttcaattttagaaaaaatacaagtcccgttaaggacttgtatttaaagtaattcttctacttctttatatttaccattaagtgcttgagctaccggcttacaagtaaaatatcctttataagtatttaatcctttcataaatccagcgtcttctttaagcgcctctatacctttgtcggcaagttttaaaatatatggtaaagttgcatttgatagagcaatagttgaagttcttggtactgctccaggcatattagccactgaataatgtaatactccatgttttataaaaacaggatcatcatgagtagtgatatgatcacaagtttcaatacacccaccttggtcaattgcaacatcgacaatcgcactaccttctttcattgttttaaccatatcttcggttactaatttaggggctttagctccgggaattaataccgctccaattactagatcagctgtttttagagcttgtcgcaaattatattcattattataaatcgtatgaataaccccattactaatatcatcgatatatgccatacgttctgcattaatatcaaaaactcttacgctagcacctaacccacaagcgattttagcagcatttaaaccgacttttccaccaccgataaccacaactttagccggcattactccaggtacgccacctaataaaaggccactgccgccatttgctttttgtagcatgttagcccctatttggactgccatacgtccagccacttcactcattggggttaaaagtggcaaattatgatttaattcaacggtttcataagcaattgcagttgtttttgaatcaatcaatgcttgtgcaaacggttgatcatttgcaatatgtaaataagtaaatatcatttgatcttcgcgtaaatatttgtattcactttctagatattcttttaccttaatgatcgaatctgctttagcaaaaacttcatcacaactacagattactgctccggcttctttatattcatcgtcattaaaaccactgccagttcctgccattgtttcaacatatacttgatgtccggccttgcataaggcaaatactccagccggcgtcattgatactctattctcgttattttttatttctttaggaattccaataatcatattctaataccttctttcattaagcttactattttcaaaataagtttagtactattatatcgcatctttagctattaaacaaaatttttttaatctctattatctttttctttatgaacttagtaaaaagaaattaatcaatgataatttagactagtatcgtcaatctcttaataattttctataacttctttatttccttagaaataaaatcaataaattttgtaacagttaaactaaatgactgatattttttccagacaaataatgaatgtgaatttaaacttggatagagaggtctaaagcatagttcgtcacttgccgcatcacaaattgacccttcaaccactacggcataacctacatcatttttcactaatattgccgccgtagtcgttaaatcagaagttgcacaaaatgatagattttcatatcctgttccgtaccagttggaaaatatagtctgcgcttcactacgcgctgaagcaattaaaggtaaatctattagatctttagatgttatatattctttttttgccagtgaagcattctttttcattaatattccccatttttcttcagcgttaaaatgaataaaatttaatttttcaagctcaaccggctctaaaacaactccaatatcaagcaagccattatcaatattttctaaaataaaatcactatttccgtttcttattcgaaaagatacatggggatatatttctgaaaatttttttattaattttcccattgtctgagtagcttctgtaactccacagcctattgctatttctccactgatatcatgactttgactgccaacttctaattccgctttttcagataaaataataatttcctcggctcgtcttttcaaaaccattccctcttcagtcaagaccatcttgcgttttccacgaataaaaaggacggcacctagttcatcttctaactgcattaattgcctgcttaaagtaggctgagtaatatgcaataattctgctgcacgagtgatatttccttctcttgctactgtcaaaaaatatttcaatactcttatttccattttttcaccttcttaatagtcgtttataattatgataaaataaaacctaaataataatgaggtagttagcaaaaaacaatcaatataccaatttcaatcacttatatcaatattatataggttttcatttatttatactattaattaaataactttaaattgacgccatttaccttttataaatcttattacaaaacaaactgaacgacataaccagtcagaccccattgcaatccatacaccaataattcctagattaaagataattccaaataacacggctgcacctagtctaaataagatcatcgatacaattccaacaaccattgaaaatttaacatcaccagcagcccgtaatccatttggtaaaacaaaagcagttggatgtaatgctgttgccatgatattatgcataataactaaaataaaagttaaatttcttgcttcacttgataaagaatatagattcaagatccacggcaataacaatataacagcactgccaatgattcctgtgacaatataggatattttcattaatttttttatatagtattttgcctgctcataatcattggctccaatacattgtcctacaacaactacaatacccaaattaatcgcatttacaacaacaactgcaatttgatcaatacttccagcaacgctattagcagcaatttgacttgtcccaaataaagcaacaatactcgttactaacacccgaccaagcgtaaataatccattttcaattccattaggtactgcaatttttaaaattctactaatcatttcttgatcccatgcaaatacgtttttaatctttacataaactaaattagatgagtttagtgataatgcgaacataataatcgctgcaacaatccttgatatcaatgttggtacagctacccctgctactccagcatgtaaaataaataccccaatataatttccaacaacattaataatattcattaagattgatacatacatcgtagttcttgttttttccattgatctatataatgccgctgctgaattatacacacctaaaaatggaaaagaaatagctgaaattagaaaatacgtcgttgctgctttcataacatccatttcaatcgcaccaaaaaatgtactaaggagtatacgatgaaatacgagacaccccagcataattacagtagcaattactattgtaatcgtcaaaagctgactagatgctttgttagcattctttcgatctttatttccaatatattgtgaaacaattatcgctccaccagcatcaatagcagctagtacagtaatgattaaattattgaacatatctactaatccaacacctgaaatagccacctcacctgcataagataccattacagtatcagctactcctactgccatgattaaaatttgttcaatgatcagtggtaaaattagtttttttaatgccttattagaaaacattgtttctacctccctttttctttacaaaaacattgtatattaggaatattataatgtctaatacctatcatctatcagtatgatacctttaaagcattataaatagcaaaactagtaaatattatctttgatacctttaatcttctttatcccatattcaataaaataaaccatgcaataactgttatctttttattaaaaaaactaaatataaatttttgtaatgatttttgacactatctgtatattaattttttctttatacttttttaatgtcaaataattgacgtattcatagaaaagtaaatataaaaataaggagaaaagcaaattatgaagacaaaaaaatttaaagaaatatcaaatgaatggattgagttaaaaaagctatcagtaaaatatccgacaattgctaaatatagagtcgttattgacacacagttagcccatcaattcaatgattatacgatggaacagtttaatgaagatattatcattgcctattttaataaactgtctactaaagaaaactatgccaatagtacccttctaagtattcgatatgtattaagagccattattaattattctcatcaaaaatataaaactaataattgtagttttgagctaattaaaattgccaagaaacaaagacaaattaatacgttgtctaattctcaaaaaatcaatttatctaactactgctttaataattttcaaccaatctctatagctgttgccatttctttatataccggtcttcggattggtgaaatttgtgctttaaaatgggaagatattaattttgaagacaactatatttatgtatataaaacagttgaacgtttaaaaagcaaggaggacaccggtaataaaactgcactcatgatacttaaccctaaaaccagttcatctaaaagaattgttcctattccattatttcttaatgaattcttagttaattataaaagtcgatatcaaatcgaagataataatgtttttatcattaccggcaataataaaatacctgatcccagaacaactcagtatcgttttaacaaattatgtaaacagtttgattttaatactaacttccatactcttcgccattcttatgctactaattgcgttatgaacgaagtggatactaaatcacttagtgaaatgcttggtcattcaaatgtaggaaccacgcttaatctttatgtacattcaagtttagaatttaaaaagaaacaaattaataaaatttccagactataattttttataaataattttattttaaaacaggttaaaaataaaatttaattactttatttcagcctgtttttattaaattattggaaataagaaattagttgtggcttctttatgagaatcttttatgcataagaaataaattttatgatctagcgtttaatagtaagtgccctattctacactcaattcaaatacaaaaaaactctacgataaaaatcgtagagccaaaccaatttataataataaaaaaacttaatttatatactagtccataaaaacagtctttatgttaccactcaaaatttacaatttaagtagaatatatcattttttataatttctgattaatccctcttatatccatgatagtgatcattatctataatattataacttatttgaatttcaaacataacttttaaaaaggcactaaatgtaatcacttggtatcttatcatttaactcacttttatttacaagatatttattataaatttatatattaaaacagtaatatttcacataatgtgtttaaaacaataaagacactccaatatttatcacattccttactaacttattttaaaaacattactattcattctaaaatctaattttgcatgatatttaataatcactttgattctcaaggattatgcaaagaatatatatgaattattgaatatttatatacatatacttcggttaatgacaaattaccccaatatcaaattttttcttatcttttactcttattcacttatttatattataaaacgctatatttatgtaatgtcaccaaaaagttagacatattaaattaaaactgaatcttgaaaaggtctgtagtctacatgcaagcgaactcaatccttttctttttgtattaattttctcattattataatactcgatatatttaataattgcagctttgaattgttcatgcaattttctttatgagaatgtaattacttgatttctttatcacttaaccatttttgataggttttatgctgacaatgtcattcttgatctaaatgaaagattaatccttttgagattaaataataattgcaaactaagatgttgagttttttattaatacatcgccttatactggaagttaaagctactaaccgataattttttctgtttccaactctatttatcagttccatttttttcgatggataaagtcagcttattatgttctaatcttattctactcgtcgagtcaaaaattcttatgacatacactcgatagattttttagatattcccatccttatatttttaaatatattctaatttaaattttttactatcccatataaaaagtgacctccttttaggggtcactacaatacattattttttaatttctctttattattctacaccaactataaatgaataaacaggctgtttaccatttactacttctaattcagcctcaaaattatcttcaacaaaactttcaatttcttcaatgtcatcatcatttacgtcttcaccataaatcaatgtaatcaattcagcatcctcatctactagtttttctaaaacaacttttaatgcttttaatttattatctttacaagcaacaatatctttttccaccaaagccatatagtcgttagctttaatttctacaccatcgatattagtatctttaattgcaaaagttacttgtcctgtttttacatttcctactgcttctgtcatttcagcaacattatcatccaatgaagcatcaggattaaacatgatacatgctgataacccttgaggaatagttttcgttggaataacaataacatttacttcatcttctaaaattgttgctgtttgttgcgcagtcataacaatattagaattgtttggaagaataattacatttttcgcatttacatctctaactgcttgaaccatatcctcagctgatggattcattgtttgtccaccactaacaacataatcacaatgtagttctaaaaaagcatcctttagaccatcacctgcacaaacagagataactgctgtttctttagcttcacgttttggtttagcattgtcatcaactccgacaatcgttcctgcattactttgaatagtatctgcctgttcttgcatattttcaattttcagtttaacaaattcaccaaatcgttgagcaatgtttaaagcattaccgggttttaaagtatgaacatgaactttaacgatatcttcatcttgaacaacaacaatactttcaccaggaattctcgctaattctttctttaattgctcctctttaaatttatcaaccaaagaaggctctagacgaacaataaactctgtacaatatccataaccttcttctccaccttcaatatcagctacagcattcatcgcggaatcagatgatttaatttctacataatcgactgtttctcctgctaatccagctaaaaagccagtaaaaactaatagtagtcctgctccaccactatctactactccaacttcttttaaaactggtaataattccggtgttctttctaatgaagcctctgcttctttaacaaaataagagaaaacatcttcaatttccattccaggctttgcgtattttactaccgcttcactcgattctctaatcactgttaaaatagttccttcaacaggacgcataacagctttataagcaacttttgcaccactttctagtgcttgagcccaaagtactgcatcagcttcttcatgaccttgaagtgccattgaaacccctctaaaaatttgtgataagataactccagaatttcctcgagctcccattaaaagtcccttagataatttttttgaaatttctccaatattatttgaatccattccctcaatttctttagcaccagcagaaaatgtcaaagacatatttgttccagtatcaccatcaggtacaggaaagacatttaatgcatcaatttcaggatgattattatgcaacgtatttgcgccacataaaaccatctctttaaataattttccagttacaactttcatcttctatctcctctactctattcctcgaacaccttgaacatatacattcactgattcgacatttacatctaaagtagactcaactacatatttaactttcttttggacttcacgtaatacttccgtcattttaattccatatcctaataaaacatatagatctaaaattaaaccagtttcaccatctcgagcaacgattcccttagaataattttctttacgtaacaaatcataataaccatcttttaattttttttgacttgccattccaacaacgccataacattcaattgcagcaccgccagcaattgtagcaacaacatctaaagaaatgttaacagttcccatattattatttttttcaatcatttatatacctcctcgtatacaattgaattgtattcatcaataactaattatatcttaaaaattcgttcttgacaattatattgcagtcagaaattattgtaacaaaccataaaaaaaattcaagcaaaaaaaatgtaataatttttcaaaaaataattgcaatttaaaactaaaaatgatactatatgcaagtacgttaaaacactactaatgaagaggaggagaacctatgtcaagaaaatgtcaaatcagtggtaaaggacctatgtctggaaatacacgttctcatgcattaaactcaagtagaagaaaatggaatgttaatttacaaaaagctactattttagtagatggtaaacctacgactgtaagaatttctgctagagaattaagaactttgagaaaatcagcttaataatataaatagtactgcggtactatttttattttatccaattatagttattctatgattggtttttttgaaactttttttcattaaatttacattattttcttattcaatgaaactatattaataaacaaggccaatgtatttacacctcaattatttcctaatatgataatactatataaattaggaggataattaaatgacatttccaaaagattttctatggggtggtgctgtaaccgctcaccagagcgaaggtgcttataacgcaggtggtaaaagtcctgcagtgtgtgatctcttccctaaaccagaacatagtgattttaaagacggaattgatagctatcatcgttatgatgacgatttttcattatttgaagaaatgggcttcaccagttatcgtttctcaattgactggtcaagagtatgcccagatggtattaactttagtgaagaaagtatgcaattctatgatgattttattgattcaatgattcggcatggaatggagccaatgtgctcattatatcacttcgaaatgccccaattgctaatgaataaatataacggattttattcacgggaagtagtagatatgtttgttacctatgctaataaaatgattgaccgttatggtgatcgtgtaaaaaaatggatttcatttaacgaacaaaatgcaattgctttaccaggcagcagtaaggtagcttatggtgccgtttgtccaaaagacattgacgaacaaacatttattaatcagctggttcacaatacttttgttgctcatgctaaagttgttgaaaaagttcatactatcgctgatgctaaagtcttaggaatggtaatatatattcctgcttatgccgccacttgtaatcctcttgacgagctagaatctcgaaatcaaatggcacttacagacatgtattttgatatgtttacgtacggggagtattcaagttatatgatggcaaaaatgaaaaatgaaaataatctgccaaaaatgctagatggagatttagagttgctcaaaaagaataaggttgactggctatcattaagttattatttttcaacagtagcttcacatggcaaactaagcattgaaatgaacggtaatgcaaaagcagctaccaatccatatttaaaagctagtgaatggggttggcaaatcgatccccttggtttacgtattggtttaagggatatttatgcgaaatatcgtttaccgattatggtcgttgaaaacggctttggaatgcgtgatattttagaaaatgaaaccgttatcgatgatacaagaattgattacatgaaagatcatcttgagcaaatcgcattagcaattaatgaaggtgttgactgtcgtggatatttaatgtggggaccaattgacattttgagttctcaaggagagatgtctaaacgctatggtactatttatgttaatcgggatgataaagacttaaaagatatgaaacgttataaaaagaaaagtttttattggtataaaaaagttatttctaccaatggtgacgatataaaaaatgattaatctaaaaattagccgttttggctaatttttttgttttaatatctatacatctaaataaaaagtaaggtacaataaaaagtaggtgatagaaatgaaaaaactaattcaaagattatattatcgtattaataatcgggtcctcgactaccgctataaagttaataaaaatgctggtttatgctttgcttactatttaatcatgtcaatcataccgatttgttcactgtttgccttctttgcctccatattaaatgttgatcttggcaccttagaacaattactaaaaaactacttaactcctgaattttctaacataataattgcatccttaaaatcaagtcatattactttatcatcaataattatcttatttatctcattatttgttgttagtcgaggaatcaaccagctttatggaatttcaaaaaacttatttccttctgcacatcaaaggaatataattattgaacaattattaatgcttttaaaaacgattgctgttttcgttttattattactaataatatccatattaacaatcatccctctaattaattattttattaattttaaagatattttagtacttggtgatttatatttatttttagttttttttattattttatttttattatataagattattccagatgttcatgttcacatttttgacattgtaaaaggagccttttgttcaagtatactgatgttaattttattatctgctcttgaattttattttagcatagcagattatactagcgtatacggtccattggcttctgttgtagttattatgatatctttttctctgattgctgaaacaatttttattggcatgtatatcatgtttgaagctcatatgaaaagattaatcattgaaatgaaaaaaaataatcattcttaaaaaaataaaaaacgaagaatatttttccttcgtttttattttttaaattgacgtttaaatgcatcaaaaattgattctttcttctttgaaagttttgataatttagtatataattctttttcttcagatgaaagtttagtcggaatcttaacttcgattctaaccatttcatcaccataattagtactacgaagatctttaacgcccttaccctttagacgcagtattgttcctgattgtgttccagcaggaatttttactgtaacatccccttgaacagttggaacatcaacttcacatcctaatgtagcatctacattagaaacaggaatagtaatatgaatatttcgcccttcacgtttaaaatgttcgtgacttcctacttgaatttctacaaataaatctccattaggtccaccatttgctcctcgtccacctttgccagctacgcgcaattgttgattagaattaataccagctggtatatctaattgtactgtcactgtcttagtttcatatccacgtccatgacaatgtggacatttctctttaacaacttttccagttccattacagtcaggacaagtagtttcagttacaaatgtcccaaatggtgaactttgctgctgttgaacagttccacgtccaccacagcgtgaacacgtttggacatcattaggatttttagccccactaccgttacaatgagtacatggtgcatcataagtaactttaatatctttctttacaccatttactgcttccatgaaactgatatttaaacgcattaagcgatcatcaccacgacgtggtcctgtatttctttgacgtgatcttccgccaccaccaaagaaagatccaaaaatatctcctaaatcaacatcttcaaatccaaatccaccaaaaccaccagcaccaccattaccagcaccttgctcaaatgcagcatgaccaaagcggtcataagtggcttttttattagcatctgataatacttcataagcttcttggacttctttgaacttttcttcagcaccaggctctttgttgacatcaggatgatattgttttgcttttttacgataagctcgtttgatctcatcggctgaagcctgtttacttacacctaagacttcataataatctcttttatcagccatattttcaccctctttttatactatttaaaaccaaggcggcaaagccttggctttaaatgattagttcttttcttcgaaatctgcatcaacaacattatcatcttgtgcatttgctgtaccagtatttgcatcactagctcctgctccaccttgttgttgatatgcatatgaagccatttgttgtgccatttgttctaattcagacattttagcttctaatgtagccatatcgttgttatctaaagctgcctttaactcatcttttaatttttcagcagattctttttgagtagcatcaattttgtcaccttgttctgctaaagctttatcgatttcattaatcatttgttcagctttatttcttgtttcgatatctttacgtttttgttcatcttcagctttattagcttcagcttctttaaccattctatcaatttcttcatcacttaaaccagttgagttttgaataacgatagattgttctttttgagattttaaatctttagctttaacatttacgataccattaacgtcaatgctgaaagttacttcgatttgaggtacaccacgtggagctggttcaataccgtctaatttaaataaacctaattgtttattatctttagccattgatctttcaccttgtaaaacgttgatatctacagcaggttgattatcagcagcagttgagaatacttgagatttagttgttggaatagttgtatttctttcaattaatactgtcattacaccacccatagtctcaatacctaatgataatggagtaacatctagtaataatacatctttaacatcaccagcaataaccccaccttgaattgcagcacccatagatactacttcatcagggttaacagatttatttggatcttttcctaataattttttaactgattcttgaacagcaggaatacgagtagaacctcctaccaataatacttgatgaatttcagttgggtccataccagcatctttcaatgcttgacgtacaggagtttcagttcttaaaactaaatcacgagttaattcatcaaattttgctctagttaatgttaattctaagtgtaaaggccccgctgcaccagctgagatgaatggtaatgaaatttgtgtttgcatagttcctgataagtcttttttagctttttcagcagcttctttaacacgttgcattgccattttatcatttgataaatcaacaccttgatcttttttgaattcttcaacaacccaattcatgattttttcatcaaaatcatcaccaccaagtttattatccccagcagtagctaatacttcaaaagttccatcagctaagtctaagatagaaacgtcaaatgtacctccacctaagtcatatactaatactttttgttcttgatctaatttatctaatccaaacgctaaagcagcagcagttggttcattgataatacgttctacttctaaaccagcaattttaccagcatctttagtagcttgacgttgtgcatcgttaaagtatgcaggaactgtaataactgcttgtgttacagtttcacctaaatatgcttcagctgttgcttttaagttttgtaagatcattgctgaaatttcttgtggtgtatagtctttaccatttgcatgttctttatgatcagtacccatatgacgtttaactgacataattgtatctggattagttactgcttgacgtttagcagcttcaccaacgataatttctccatttttaaatgatactactgaaggagttgttctgtttccttctggattagcgattactttaacttcaccgttttccataacactgacacatgaatttgttgtacctaagtcaataccaataattttacccataattaaattcctcctatttattcacttacttttactaaagatgcacgaataacgcgatcttttaacttatatcctttttgtaactcttcaacaatcatatttgttttaaagttatcatcttttacggtcataactgcttgatggaagtttggatcaaactcttcaccctcagttttaattacttcaacaccttgtgactttaatacttccatcagttggttataaatcatttcataacccttcaaaaagtttttaatttcatcactaggatcaactacagctaacgatctttcaaaattatctacaacaggtaataattcttcaataaatgattgcatcataaatttcattgcattagcatgttcgttttgtaatctcttcttaagattttccatatcagcaaacactttataataatcagttttccaagtatttacttcatcttctaaattcttaagttgatcttcaactgtaatttcatcttcttttgtttcaactgtttcttctgcagtcttttctgtagattcttcatctactactgtttctttttccttagccactacattcacctctattcatcgtttgaatcatctgattcgtcaaagaacgcctcttcaatattccttgaaatatactctactaaggaaactactttttcataaggcattcttgttggcccaattactgaaatagatcccttggttctctctcctgttctaaatgaagctgagatgaccgatacatcctcaatttcattaatcggtgaatcagaaccaattcttaccgttactccttcttcatcagataaaggttgtaaggcattccatacttgagagttttcaaatgcactaacgattcttctcaatttatttacatcattatactcaggctggtataacatattttcttttcctgaaaaatatacattgctcgaagcaaatcgaacaaaagcttcaagaaaagcattaaataattcctcatgctccttgattttagctgataacaccggttttacatcacgttctaaacgaaatgctacctgatcaatcggtgtccctatcaataaatcattcatcactgcaacacaactcaccaaatcatcaattttatgattacggtttaaatcaaacaccttgttttcaacatagccttgattcgtaataataatcgcagtaactcggttatcattcaaaggaacaatattgatttgctgcaaagtatcttcgctagaatctggtcccaagactaccgatgttagatgcgttagttcacttaacatctcacaactttcatgaatgatttcattcaaaccacgatgacgatcgctaaaaatttgcgctacttggtttttaatcccttcatctagatcccgctttgcaagattatcaacatagaatcgatatccttcaaccgaaggaactcgtccggaagatgtatgagttttttctaaataaccatactcttcaagaaaactcatctcattacgaatggttgcacttgaataaggcaattgatattttgtcatcaaagcttttgacccaactggttcagccgtttcaataaactcatcaacaatacatttaaatactaatagctgcctcgctgtaagcatcagtttcaccacccttagcactcatctttcctttgtgctaaatacattatacatcaataattagcactgtcaacacctttgtgctaaaaaataaaaaaagaattataaatccgatttctatttaaaacaactctataatcaatctaatcccttgataaaatcacaaaaaaaacagccctaaggctgttaaattttttcaaaaacacttgccggttgtttacaaactggacaaataaaatcttcaggcaattcatctgcttctaaaataaatccacaaacagtacatctccaaccatgttttgaagtatctgcttgataactagaagcatttttaggtgttgttccatttttcttattatgataatttgcataagttaatacttcaccttcattaatcactttacaatcaataacatcgccaacaaacataatatgtgttccaacatctgtcattgaaataactttaacactaaatgaagcagctattccttcggtgatttgtttaatattttgacaatcaacttcataatcaatcccatcaaatttgttaacatctttaccagactgaaaaccaaatcttctgataacatccatatcaatatcatcaagtaataccccaacgttataaacacaactattttcaattaacgatgtagtataattatttttattcagcgtaatgcaaactcgtgccggctctgaagtaacctgtacaaaagtgttagcaatacaagcactgtccttaccatcgcaactgctagatacaacatacaacccataacttaacttaaaaaatgctttattgttcatatcccaatctccttattagtaatgattactatttgattatacatcttttatttcctattgtaaacccaatttagaagatttaaccgttcactatacgataactcatctaattatccccgtttataaaaaatctattaagatttcatttaataacttaattgattcactagttgcatgtaaataatcattttcaattactaacgttttcatcttcaaatgtttatcaatagcagtttgataaacatcaactgctctaagaccatatctcttttcaaattcttttaaatctaagcctttcaccaaacgtaatgacatcattaaatggttaaacatcgtttcttctttagaattaatcatctttgtgattgtattttgacgacgtaaataagcatttaaattacgattatgttctattaagcaatcatcaatttttccactggctcctaccccaattccataatagttatcatactgccaataagctaggttatgaagtgactcatatccagttttcgcaaaattactaatttcatatttatggaaacctatttgttctaaagattcctctatcaattgagtgattttcgattccacctcttcatcaagcggttgataatttagatttttcaagacagtatgatcttctaaaattagtgagtagtaagaaatatgctcgatcggtaactgtctaaccttagctaaatcattttttatatccgtaatcgtttgattaggcaaaccatacataagatcaattgaaatattattaaaaccaattttgcgtgcataatcgataatccgctcaacttgtatagtcgtatgctggcgattaatcttttttaaaaggatatcattaaatgtttcaaccccgatacttaaacggctaacaccacctctttttaaaatatctaatttataataatcgatactttctggattaacttctatggacacctctttagtctcactacttatgtatggtttaataatatccatcagccattctaattgttcatcatttaaactgctcggtgttccaccaccaatatatatagtctttagcggctctgtaatatttaaagcttgaagttcatgttttaaaaccgccaaataatcatcggcttgatgttcgttataaaaaactttacaaaagtcacaatatgcacaaatttgttcacaaaaaggaatatgcagatataatgaattagtcttcattttcaaaaccaaattctttagccaaaccacctaaagaagtttccttatacgcactatttaaatcttttcctgtttctttcatcacccgaacaaccgcatcaaaagaaactttattttttctcaagtaacccagctgcttagcatacatcgccgcatccattgctctaagtgcaccaaaaccattacgctcaatacaaggaatttgaacatagccgcctacaggatcacatgttaaaccaagattatgttctaagcccatttcaccagcatattgaatcagattattattaagttctaaaatccagccataagcagccgctgccattgcacaagcacttccgatttctgcctgacaaccaccatcagcgccagaaatagttgcatttgttttaataacattgccaaatattccagctactgctaatgcttttataatctcttttcgaggaatttctaattgtttgtaacaataatataagactgctggtaaaactccgctagctccacatgtcggtgcagtaacaatacgatgtccactggcattttcttcactaaccgcataagcataactactaactaataagcgatctcgttctccactacgacgtgtgttgattgcttgttgatacattgatttagcaactcttttcaatcccagttttcctggaataactcccgttgttgataatccagcttcaacacaagcaaacattgcatttagtacttcaaataaataagctttaaaatgctcatcttcatactcgattgtataatcatataaattgattcctttacgatcacaatattctaaaatttccgttaaattaccatgcggatatacttgcttagaaggttgcaaagaactatcatcatacattaaagctccaccacctactgaataaactgtaattttatcaagcaattgattttcccgatatatttcaaaaatcatcccatttggatgtttaggtaatgctgtattaacaaagtgtatcttaacactatctttacctaaagtttcttcaataatgtaatctgttaaatggcctttccctgtcaatgctaacgagccatgtagatatacttcaaaatgtgtagcctgaggataggtttccttaacttttaatgccgctctttgtggtcccatcgtatgggacgaagatggtccaaccccaattttatataactctcttaatgattccataatacctcctaaattcttaccataaataattctaaacccatttttttatccattttacctgttttgatttctacatcaagacgtgataaatcatctaaacattgcaataattcatttaaatcaaaatcttttccttcttgacgaacatattttaatcggtaaggattaactcccagtatttttccaatttctttatcattataacctttacgatccaataatttaacttggtaaattagccgcatttgacccgctataagaacaatcaacttaattggttcctcatttaaaatcattagatcatgataaatcgaaaacatttttcttcgatctttttgaagaatcgcactagttaatgcaaaaacattttcatccaacggcttacttaccaattcatcaataatatcatatgtaatatgtttgctgtacaaacatagtttttccacctcaagagcaacattattcaaactatctcctaaacgactcaataataattctaatgcatcatcatcgatcgttgcatctcgacgtctgattgcttgacgtgtactgtctgatagcttataatgattaactttatctatttcaaaaaattgtgcttgtttacgtaaatttttaacaatttttttacgctcatcaaaatctttaccaacatgataaattacaaatattacttcttcactattaattaaacatttttcaaaatactctaactcattattatctttttttactttctttgtcgttaaaaaataagggtttttcaacacaaccattttcttgtcggttaaaaaaggaggtgtgatcaaatcttcataaacttcttctaaactatcttcattagcccgatatgttgaaatattcatattatcctcattacaatcatattctttttttaaagactgtaatttttgttccatcaaaaaactttcttcaccatatattacaaatatcatttatcgttcctccaacagtaataattatagactatttaatcattaaagtcattgaaaatataattatcatcaccataataaacaatcttcaccatgcccatttcatcactacgataaacctttactccataatcatttaagcgggtaattacatcatcatggggatgaccataataattatctttaccacagctaattagggcaattttaggttttattgcatttaaaaaagctgcactagtccccgtattactgccatggtgggaaacctttaatacatcaattttaagctctggataatcgttgatcaactgtcgttctactgcattggatatatcccctgtaaataaatatttcaacttattgatcgttaccaacaaaactaacgaactatcattattatctgttgattcaggtgttttcagtatctcaatttctacctgcccaattttaaatttatcttggtatgatgtaatagtatgtccaatttcaatttgatccgcaagtgactgataagctccactatgatcaaaatcatcatgagaaataaaaacatgatctaatttaaacactcctaccgaacgtaaatatggtactaatgttaaagcagctagatctttatttcgcaatcccccagtatcgattaaaatatttccttgattataaggctgttgaataaaaaaacaatcaccttgacctacatcaatcataaccacttgaccaaaagtctgatagtatggtttaaaataaaacatgatcactaaacttagcagtaatagaatctcacggtgaattcgctgtttaatatttattttgactattaatttaaaataaatatagtaatatcctaaaataaaaaataaagatggtttagaaaaattaataaaaaaagagaagtccgtactaaaaacaacaatattatctagaacttcaattactagactaataaccggtttaaagaaattaccaaaaatcacatataaccatagcagttgatataacactgaaatcagtggtgttaaaataatccctaaaaacaatgacagtatattaattcgatattgaatcgaaataacgattggtacgctagctccataaactatctcattcaggtacctatgatgattaatcaaaataattattaaatacataaaataggaaaaaacaaaagataaattataaataatatatggattcataaatacaaaaaacatagcaacaagactaaagcagtctaattgatttagatactttttaaacaaagtcatcaaaagcattactaaatacgcccgcataaaagaaatattatatggaataatatacatatacacaccaattataattagactgaggtaattaattaaatattccggtaataaaaaaattaatacttttttaatcaaccttcttaatatatgaatatgtagtcctgacaaagcaaacaaatgaacaatcgacaactctgttaattgatgataataatcattgatcatttcatctcttattcccaaaataaacatgcttgcataactattaactagctctttaccgtctattcgtttttgaagtttttgaaaaagcgtattatgtttttgactatttataaggcgtagtaaagatgcattattagtaatcccttgactatacaaatagttacgataatcaaatgcgttatcgtttgttgcacgactaatttcaaaataattaacctcaatttctaattcatcaccaacttcatagccaataaactcaccatatactttgatctttgtttttgttgttttcaatacaatgctcttttcatccctactaattatatacccgcttataattggttcatcggtcggctgaggccacctaataaacactaaaaagaaaatcataaccagccctatcgttacaagtcgtccccacccaaaatgacgaattataaagaacgcataaataattaagagcactaaaaaaactggatgaatcaacatgaccaaaacacctaacaaacatgctaccgcatagtaaatcaaatgatatcttaaagacataataactcccttattcgcaaataagttttttctcctatccctgatacttcttttatctcttcgatggtagcaaatgggtgttcattacgataatcaataattttatctgcagtttttggtccaattcccttaatcgtcatcaattgttcttttgatgcatgatttaaagaaattaaatttttatttatagggatataaaaaactgtttggctatccaaaacagttttttgatcaaatccataaacattatcagtatttaatgctttaaatacatcttcgattgttggtgaagaattaaatactaaagtttcattatacttaccttcaacaattatttttacttgtggatctaattcaatttcatttaatgatgtttcaggcaatgtaaatgaataaacagttgagataattaaaataattaacaaaccaataatttcatgttttttcacaatacctccacaaaaaaagactgtaaaaacagccttattcatcaatatttatatttaaatgtttatatgcttcactcgttgcaacacgaccgcgaggagttctctttatcaaaccgatttgaagaagataaggttcgtagacatcttctaatgtttgtggttcttctccaattgaagctgccagagattccaaacctaccggtccccccttaaagcgatgaatgattcctaacaagtatttatgatccacatcatctagtcctaattgatctactttaagacgatctaaagcctcaatcgtccgctctttactgataatttcttcaccgttgaactgtgcaaaatctcgaacccgtctaaataatcgattagcaatacgcggcgttccgcgggaacgcatcgccaaagccgatttagcgtcatcatccattggcattgagtagacacgactggtccgatcaataatcgtttttaaatccgtttcatcgtaatattccagtttagaaataattccaaaacggtctcgtaatggtgctgacagatcaccagctctagttgttgctccaactaaagtaaatggcggtaaatcaattcttactgaacgtgttgatgcttctttaccaatcactacatcaacacaaaaatcttccatagctggataaagaatttcttcaaccactttatttaaacgatgaatttcatcaataaataaaacatcacccggttccaatgctgttagaatagcaactaaatcaccagttttttcaatacttggaccagttgtaattttgatatttgtccccatctcattagcaataatcattgacatcgttgtctttcctagtccaggaggcccgtacaataacacatgatctagtgattcgtcacgcagtttagctgccccaacaaaaacttttagattttcttttaagttagtttgaccaacatattcatcgaatgatgaaggacgcaaactactatcatcatcaataacatttgcatcaagaatctcattccttgtcattttctacctcctactttactaataaacttaaagctctttttacataaccgttagtatctagtttttcatttaacaggactgccaaagctttatccacttcagattttttataacctagggcaattaatacttcagccgcctcgtctaaatcattattatttatcagtgttgttgctgttggtgtatttttaaacttaccttgaagatctaaaataatctgctgcgctgcttttggtccaattccaggaattttctttaaatatgctacattccctgtttcaattgcacttataatgcttgttacatcaccagtagctaaaattcctatcgctgttttacaaccaatccctttgaccagaattaattttaaaaacatttctttttcttcacttgttttaaatccatataataataatgcatcttctttaacttgttggtaaagaaaaatctttatttctttacctcgtgtatattcatatggattattgacatatatcaaataaccaattccactattttctacaacaatatgatcaatattcatctcaactaccgtaccaattaagtaactatacattccctactccttcacatttactattatacagcacatcgtactgttttttatctcaaaatcgtttcaaaccattctcaacaattatagcattgtaaaagaaaaaaaccaactagtattactagctggttactcataaaaatcaaattcaaactcaccgatagcaacattatcaccatcttgagctccggcatttctaagtgcatcatcaacacccatattacgcattttaatcaatagtcgttttaatgaatcatcacttactaacgatgtcattgccaccattctctcgatcttcttgccagtaatttgccaattaccattacctaaattatgtaattcaaatggtttatcttcctcatcacccattgtataaagaacagtatgttcaacttcatcttccattgtgaaagttggtgcagtagctaacgcatcagcaaccgcatataaaacctgatctacaccatcatgaataatagcactaattgggaaaatcttaacatcttcaccaacctgttttttaaaacgaactaaattttcttcagccccatcttcatccattttatttgctacaacgatttgaggacgttctaataaacgatattgatattcaccaagttctttattaatagtaacataatcctcatatggatcacggccatcgactgctcccatatcaacaatatgaacgattactcgacaacgttcaatatggcgcaagaattgatgccccaaacctttaccttgagccgctccctcaatcaatcctggtaaatcagccataacaaaactacgtccatcttttacttgaaccactcctaaattaggaacgatcgtagtaaaatgataatctgcaatttccggacgtgctcgtgaaacaactgataagagtgttgatttacctactgatggaaaaccaaccaatcccacatccgccaataatttcaattcacaaataagatcgaaattttcaccaggttcaccacgctcacaaatttgtggtgcaggattccgtgaagttgcaaaacgcgcatttccgcgaccaccacggccacctttagcaattacaacatgttgcttatcttcggttaaatccgccatgatctgcccagtttcttcattaagaatcattgttccaaccggtactttaatgaccgtatcaatagcatctttaccatgcatttttttagccatcccattttgaccagatggtgccttatataatcgattatatttcaaatctaacaaagttgataatgaggtcgtcgcttgaaaaatcacacttccaccacgaccgccatcacctccagctggaccaccttttggtacatgggcctcacgtctaaaagctactgtcccgtcaccgccttttccagcttcaactctaatttttgctttatcaataaactgcatatatccacctcttttcatctctttattattatgatacaaataatcagttattagtacaagaaaaaatccctttgcagggattttaattatgcagctgggtaaacagaaacttgttttctatctctaccaagtctttcgaattttacaactccatcaactgtagcaaataaagtgtcatctccaccttttcctacattagtacctggatgaactttagttcctctttgtctataaataatagaccctgcagtacaaaattgcccgtcagataatttagctcctaatctttttgatttagaatcacgaccatttttagttgaccctaccccttttttagaagcgaataattgtaaatctaatttgaacatcatatgttacacctccactttagatatcttaataaatcgaccatagctttcaaccatcgtttctaaagttacaacaagtgtctctagcaccacttgacaaacttcatcagtatgattgacaactacatttatatatccttcattaatctcaatcgttcctaagcctttagctaagaatcctttttttgcaagcatattcattgctccaataccaacagtagaaacaccagcacaaactaaatctttaccatattctccactgtcagcgtgacctgtaatactaagattaacaatttgattattattttgttttactaaaaccttaatcatttgattaagcttctgcagtttcttcagcagcttttttagcagttttattaattgtattgattactaattttgtataaggttgtctatgaccttgttttttgtggtaatgttttttagcgttatatttataaataacaactttcttttctttaccttgtttttcaacagtagcttcaacagtagcaccttttacataaggagcacctaatttcattgttttatcgcctacagctaatactttatcaaaaacaactttttctcctgcttcaacatctaatttttctacaaagatagtatctccggcttcaacttttaattgttttccacctgtttcaataattgcgtacatatcgcacctcctataatattctaagactcgccaaccaaggcagcattgctttaataccttttatgtgcggttgtagctagaggtctacaacatatgcattatattatttttacccatcaaagtcaattactttttaagttttttattaaatattgaagtacttctttttcactataaccattcccaccaatcaaataataattttcatatgggcggtaaaaacggtagtcatgattaattttaagccgatgatattgattatcatgcatccttttcaaatataatctgataattatataacggaactctttaatatattgataatttatatagagcaaataaaaataaactaagatatatcccatttgattatataatacaatcaaaactgataaagaaaaaattgaaactttaatttgtaacttgactgctcgataataatctttaaataatgaaaaaactagtaataatatttttgatccatcaagaggataaatcggtaagagattaaaaacaaatactaattggttaactgccaataaatattcgctatcaaaaaatacttttattactataaacattcccaaatgagtagatagacccgccatgactattaccagttcttcaataatatgatgagtcccataatcatttaaactcaaaaaagctccaaaagggaaaatctcaactttctcaatttcaaaattaaattttttagcaaaataatagtgtccaaattcatgagtacagacaataaacaaagcactcaaataagcaaataaattgtcatttaaccaagcagcgattagataaatcaaagtaaaaggatggatataccaatcactccatcctttgatactcttcataactaatttccttacctaaatgttcaaactgtaaaacaaactgatcttgataactgcctaaaaccatcccttgatctacctcgtcatacaatgtcaccattacattatcaatattactataagtaatttctacatcattcttgcctagaattactacatatccgctcaagttttcatcattaccagttgcaattacgcgcccagcttcaatacttaatacctcattactattatttttataatagtcatctttaacatgctgatactccacgccactagaaacactaacatcatcacttggcaaaaaagaaaataaattatcagatatccagcttgttaccgctttataattagtatcattcaaaatcattttcttaatattagaatccggattgattttaatatatgacattgatactaaaaccactaaaattacgaccataaactttaccataaaattatagaatcgcttaaaattatcatcatttaatggctttttattagtaccccggcgcttttgcattctttttcttacatcatctagatcactcattctatcacctattccattatatgaatctgatgatattaaagacgttaattatgaataaaaaaatcgacgaattaaacttttctttttatatttagcataaggtacttgctgcccgagtatgcgctttgaaatattaacaaaacagctatgtaataaatgttgattatttaagaaaatcggcacaccacgattattagcttcaatcatatcatggctatcgtaaacaatccctagcagcggtaatgataaaatctcttgagcatcttccaccgttaatgagcgagctccttcaatatcatcaacattaactttattaatgatcatattaatagtattaattccctttttcatcaataaaccaacaacgcgatcggcatcacgtaatgatgatacatctaaattgacaacaacaattgcttcattagctaatgaagcagaatattgaaaacctttttcgactccagctggactgtccacaataataaaatcataatctttatttaatcgttcaattaatgaattcattatttctgtatctagattttcaaatgataaagatttacatgacggtaataagctcaatccatctatacgcttatccttaactaatacttgttcaattgtacagcggccttcaacgacgtcatttaaatcataaactacacgattttctaaccccatcatcacatccaaattcttcaatccaaaatcaccatcaattaaacatactttaaattttgaaaaagctaaggcactagccagattaacgctaacactacttttacctaccccaccttttccggaagtaactacaataactctagacatatatcatatcccccttatctaagaatatttcgttgtccttataataaagcatcgtaagttcataacttgtataatttcgtcgagataccccattaattctaacatgggcatttttaaagaattgtccactaatttttgctcgagcatttaatccctcaaccaatccactgacgcgccccattacatacaactttcctttaaatctaacaatagctccgggattaacttgaccaataatcaaagcatcttgatccaattctaaaatttctccagcatgaacagttttgttgattactttaatcttatttttcttctctactttggccatattgattccatcaaacaataatacctgcttactaaataataaatccaataatcttaataattcatgaatacttaaaattcgacttttaaaatcaaaaaaagccctcggataatagccatcacttttaagcaatggtgattccaagagactttccaattcattcattaaactattaaaatcttgattatcatctaaaacaaaaactagatgattattaactccttttactttgatatgcattgactttaccctcgaatcctaatttcttgtggataaaatatactggtgcaatcaataataaattagctcctaacgtcggtaaaagacgatttgtcaagaaagctacgattgatagctgcgtaacatttgttatccacactaaccaatatatcacaacttcttgggcgattattgtcacaattacggcgataaacatctctaaaagggtataagttgctaatttagtatatttctttccaaaaaaagcataaacacaataaagcaacacataaatcagtaaactatttgcgtagacaatcgcataataaagtccagtcacagttgcaaatatgtatcggtgttcatcaccaattgtattattcagcaatgtgaacatcatcaaactaacacaaggaacaattgttattcctaatttatcaaaattatacggtaaataataactaataatgctatcaacaacaaaacttaatgccatcactagataataacgatataattgcttattcattactatcgctcctaaatactaccgcaacatatgacagatcattaaaatctgctgccggcttaactctaattgtttttgatgttccatcttcagaaacaatagaactttctacagttccaatataaattcctttaggcgctttcccacctaagccagaagttattactttggcattatcttcaaatttttcaacatcactaaatagagtaatttcaaaacattttgactcaatgtcataacgatttaaaagtccataaacattttgatcaccattaataacttgaatcggtaatgcagaagtaggattctctgctgttaataactgaactcgcgccgtcacttctgtaaccgaagtaaccttaccaatcattccttttgaagaaattacgaccatatctttgctaactccagccaaacttcctaaatcaattgtaatttcgttattccaatcatcactttcacgaacaaatgatgttgtcttaacattataatcagttggcaaatattcaatatttagcatctttttcaactcatcaatctcttttgaaagaacatcagtattaacttcgacactggcataagatgataattttgcttttaaaatcttattttctttataaacatcttttaactcattatattcactaaataaattacttacaaattcaactggtttttttactacataatactctattgcagcaatcgaatcgctgaccattcgctcaagtcccccttgggttcttgaaaataccaatgatatagtagaaaaaacaacaattgctaccgttataattaaaactattctcttatttctttgttttttacgattattcaaattaccacctcacatccatatcattataaggcattaatataaaataatcaattatctttaaacttcaataatcttatttgaagcaaaactataaaatctactacgaccaataattaaatggtcaactacatctatatctaattcttttgccatactatataggcgctcggttgcttcaatatcttcaattgatggttcaggattacctgaaggatgattatgaacgaccatcacacgattactaccacagatcaatgcttctttaaacagctctctcccactaataatagatatgttattcccaccaataaatacggttttttctttaattacctctaagcgtgaatttaaacataatacaatcactttttcctgctgttcaaacattaattgatttttcaacaattcataaccatcacgcggttctttaatagctgacatagccacaggctgtttatccaaacgtttagcaatttcaataatagctaaaacttctattgctttagcttgtttgattcctttaatctgaatcaactgataataattgatatcatgcaaataacgaaaacccccaatttcatttataacacgttgagccaattcaatcgctgattcttgcttatttccagttcttaagactaatgctaataattcaatattatttaggctttcaattccgtgatggaaggctttttcgcgcggtcgttcttccaatggatagttttttaatttcatgatcctaattctttaataattgcttcataatcttgtttttcaataacctctttaaaactactttcgaatttcgtttgttttattacacatgtgattccactttcactaattgtattccccatgtcctttgcctccttttcatccaaaaacacacctgttatcactacgaaattattatctttttgatacttataattcggtttccctaaatctgataacttttttatcatttcattagcgttttcatcttgtttatatattcctacttgaactatgtaagtattaatataactattgatcgttgaaaaaaacttcaaatagattccacaaaaacaaattgataaagcaactgctaacactactacaagtcttactattttcatcttgcacctccaaatctagtatatgttagcagtttataaatatgctcaattaacgtgtaattgaaaaacgttttcttaataatttagcaacgctataaccagcagctacagctactaaagaaatcacataaacaatcgctccgccaccattgatcttttgctgagatgtaatcgataattctttcattttaacgccactcgattgaaataattttaggaatcgatacacgtccagcccccgaacgaaacatcttataaattgcagttccaattacgacacaaaagaaaaatcccgtaacaccaccgcccattacttccatttgcatacattgctgtaattcattcatttttcttgtctcctcttttgaatttaaggtcacactcaccactaaaccttatattattatttactgcaagaaaataatttttacttttaaaaatagaaaaaagatgaatttcttcatctttttacatttgctctaatttttcttttacagcatcatacttagattgataatccgctaatttatttctttctagttcaactttttcttttggagcttttgaagtgaacttctcatttgccaacatattttgacaacgtttaatttctccttctaactttttaagttgattagctaatttttctttttcagcatctttatcaatataatcccctaattcaactaataatgaattaccacctttaattgtaatatttgcaacctcaccagcagcattaagattataacctgaacaaactgcattacataatttcttgatgtaaggtaaacatttatttaacaatccttctagatcatcgtttttagtattgatcacgtatggcacttcaattgcatttttaatcgtatattgtgttctgatttcacggataccttttacaatatcgattaaatatgtaaattgatcattaatactttcatcagtaaaatgatcatttacttctggccagatagcaatacaaatagattcttctaaatgtggaattgcctggaagatttcttcagttacaaatggcatgaatggatgcagcattttaacaattgcatttaaaacataaactaatgtatttaaacttgcctgtttttctgtatcattagtactatttaaatgtacttttgtaagttcaatataccatgaacagaagtcatcccaaataaatttatataactcactaccaacattaacaaattcaaatttatccatgttaatatctacttcacgaatcacttcatttaaacgatttaaaatccatttatcacaaagatttagattatcaaatgataattcttcaaatttcatttcatcatcaatattcattaaaacaaaacgagcactattccaaattttattgataaagttccatgatgcttctaatttttccggaatataacgcaaatccattcctggtgccgaattagttgttaagaagaagcgtaatgtatcagcaccatattcatcaataacatccatcggatcaacaccattgcctaacgattttgacatctttctcccttgttcatcacgaatcaaaccatgaattaaaacatgttcgaatggtctttcctcagtgaagtgtaatgattggaaaatcattctgctcacccagaagaaaataatatcgtaccctgtaactaaagtattggtaggaaaataacgcttaaataattcactatcggtattaggccatccaagtgttgaaaatggccatagtgcacttgaaaaccatgtatctaggacatcttcgtcttgtttccagttttctaaatcagcaggtggatttttcccaacataaacttcaccggtttctttatgataccaagccggtacttgatgtccccaccataattgacgagatatacaccagtcttcaatattttccatccactgattaaatgttttttcaaaacgttcagggacaaaatttactttagaatcctttaactgattttctaaagctgccttagctaatggctccattttaacaaaccattgttttgataaatatggttcaacgattgcattacttctttctgaatgccccacctgatgcatatgtttttcaatatggtcaacaaccccagctgctttaaaatcagcaaccaaagcctctcgacaagcaaaacgatccattcctgcatatttatgtgccagttcattcatagttccgtcatcattcatacaaattggcatttctaagttatatttttttgctaacgcaaagtcattagggtcatgagcaggggtacatttcattaccgctgtcccaaatgacatatcaatatagctatcagccatgattggtaacgcttcaccattagctggattgattgcttttttcccgactaggtgagtataacgttcatcatcagggtgcacaaatatagcttgatcggcaaacattgtttcaggacgtgttgtcgcaataattaattgttcatcactatcaacgatttgatatttaaaataatacatcgccccttcaatttctttatgaatcacttcaatgttacttaatgccgttctttgaactgggtcccaattaatgatccgtttcccttggtaaatcaatccttcattatataatttaacaaatacttctttaactgcttcgcttaaaccatcatctaaagtaaaacgttctttagaataatctaatgataaacctaatttttcccattgagctcgaataattgaagcatattcttccttccatgaccatgctttttctaaaaagccatcacgaccaagatcataacgagaaataccttcttcacgcatccttgcctctaccttagcttgagttgcaatacccgcatgatccattcccggcagccacaaagcatcataaccttgcattcttttataacggatgatcatatcttgtaaagttgtatcccaagcatgacctaagtgtaatttaccagttacattaggtgggggaataacaattgaatacggctttttgctagtatcaccagcttcaaaatattttttatcgatccaatgacgatattttccttcttctactttatgatgattatacttcggttccagttgtttgctcatcagttgttacctccaaatcaataaaatcatttttgttttcacgaataaatttagctgctttattaacaattccagaagatttcaacattgacaataatgagcttgtaaaatcagaaaaattatattttccataatcactatcttcatctaattcaatttcttcctcattttcaatcattacagctaatttttctgctgcagtcatcaactcagcaatttcatggcaatccacagcctcaaatgctttaatggcatatggacgataaaggcaatatggttccttaataaagaatgagtgcaatgaaccacgccctccttccattgaaagttctacttgataaatagtgtagatcagtaattcgcttggtgtcattacatcaatcaatgttccagtaatttcttctccttcatacaatttatcttcttttgctaaaaggtggaataaaacagcatgtgttaactcttcatcaggagtttgatcaaacacttcgcttgtaaaatgactatacttaacccggttttcttcatatgcagcccgctgttgtttttgatattttttaacttgacgcattttaccactataaaaatacattaaaaataaacatccacctaaaaataaaatccaaaccactgaataactcataatttcctccttaaaataaaaaagcaccgtcataaggacgaatgctcgtggtaccaccttactttgcatagcttatctatgcctcaagaccttaacgcagtcatacgtgtctacctactttttttcaatagacatgctcctaggctaccttcaatccattatcttatccccttccaccagccagggactctcttaaaagtttctggatctactcctcctaatcattgctagaaatattctaacaaaatcatcagccctagtcaatcgctaactttttatttaacgaagaaattgaatccaaataatataataagcgagacatcatgataatattattaatttcatcatgtcctaattcaatgatcggaacaacatgtaacaaacactgtaataaaagccgctcttcttttaagagctttatcttacaaaaataactatcaagaataacgtcaaaatcaaagataaactctggaattctttgatacatattataaatatcataaatacataagttgattttaatttgatcaatagaaattaatttactttctttcatcattacatgactataattaaaattattatatgtcagacataatcttatcgtatctagattgcaaacatattgttcatagcattccaaaagttctaaggctttttttagacaaccttcaattcgatgataatttaaaacaaacatccatcctgttggactacgatacgataaaacttcaaaattactcataatttcattgtaataagcttgacgctcatgaataatatttgctatatcttcaatttgacgtttaaaaaaactctttgaaacactataattaaaaaaagaagttgaatgcaaatatgataagcattcataataaaattttaattttaattctttaacgattgcattatcacttgctaaccaaggacttaaataaaaagttttatcctcataacttgttagaacttgttttttataatttctgattactggcaaaaagcattttaaatgcaagctctctatatgatcaataacaacagtcaatccattgtcttcaacaaactttaaacaaaagaatccttcacgacattttactttatagactttttttgttactttaatataaccaataacttctagtgaataggcttccttaattaattcgttcatggaacatatggaatgattaagacactgccggcttctagagccttatcttggttataattgcggattatttcttcatccacactataacgggtcgccacttcactataactatcattttctttaactatatataagtaataagttcccacactatcgctagtgtcttgaaaaattggtcgtgacttgctttggtaaaccttttcttgaagttgttcactaatctcctcagccatagctgtttcttttttactgacttccattacagcagcttctttagcaacatgtgccattggttctttggtcatatgaacagccggttcttttgctgcgtgtactgatgactctgatttctgcggtattacagcaacttttgatgtttctaagtttttaggatgattatccatttcttttgccactgcttttatctcttttactgttgaagtcgtagtttcagcagccatcggcttactttctggctgctttgcttgagcaacgtaagctggagttactggcccagtttcttggacttcgacaggtttagctcgaactaattgctcaattgaagcattagctggttcagtatccttgattaagttttcaatttcttcaagtgcttcatcatgcccaagatgctcatcccgtacatatcgatcttctccttctaccaccccatgaatacctacttcaatcttaatttggatatttccatctttaataaaataatcaaaatcttcaactttaatattgaaatctcgctgatcaacaatcttatcaaatgttgccaatacatctaattcaatattttcatcaaatttatgattgccattatactctcctttaacaattaaacttcctactgctcgaacgcctacactttcaatcttgtaattaatagactcatctactgataatgataataattcattcaattgatgatttaaatcaatccatttttcaaaatatatcttttgcatatatacctcccatcaaactatatgcacgattcttaaaaatatgaaaaaagaccgccttttatagaatatactaattcattctactttgttccaccagaatctagatactttgatattatttaaacaaaataaaagtagatacatttaaaagctctatctttcttgcatctaccatcattttactttttaaaatctaattaaaattaatatcgcatagctcatagataaagttccatgcttcttcaattccttttttccttaagcttgaaaaacgaacaaatttatcttcaggatgaaaccccaaagtatctttgataattttttcattctttttcagatcatttctttttaatttatcttctttggttgccacgaccattaccggaacatcatgatgtttaacaaattcatacatcagcacatcatctttagtcggtttatgacgataatcaactaataaaataaatcctcttaaagttgaacgtaaagttatgtattcatccattgtcttaccaaattgcttagtaatactatcattaactttagcataaccataaccaggaacatcaacaaaatataatgcatcattgacattaaaaaaatttaatgttcttgtctttcctggagttcctgaaactttagctaaaccattatgatttaacattgcattaataaaactgcttttaccaacattactacgtcccgccaaacacatttcaggaaaactttcttctggccattgacttttccatgctgcggataaaacatattctgctttctttatttttaccattctcatcacctttttcattgtaccacacaataagaaaaaaagggttatttttaaccctatttttcaagtgcgtgatctagtactgtatcaatatgatcagctaatacgatttctaattcatcttgaacagattttggtatatcatcaatatctttagcattatcctttgggataataatctttttaattccagaacgatgcgctgaaattgatttttcttttaaaccaccaattggcagcacatttccccgtaatgtaatttcacccgtcatagcaatatcattgcgaaccggctgatttttaaaagctgagtagatagcagtggtcaaggtaacacctgcactagggccatctttctttacagctccttcaggcacatgaatatgaatatcttctttatcaaatgcaattttttcaagaccatatttctctttattagcttttatatagtctaatgcaatcgatgctgattctttcattacatcccctaattgaccagtaataataaatttaccagatccttggaaatgattgacttcaattggtaaaatatctccaccaaattgtgtatatgccataccagtaacgacacctatttggctatgatctaatttcttagtatgttcaaatggtgctttacctaaatgtttttctaaactttctttattaactgttaagttatcacgtttttcttttaaaacgattaataccgctttacgacaaatctttgccagcaatctctcaagatcacgaactccagcttcgcgcgtatagtgacgaataatcgccataattgcatcatcttcaattactagttgatcttcctttaaaccgtgtaaagctaactgctttttaattaaatgatttttagcgatcattagtttttcttgttctgtatatgaagatagttcaatgatttccaaacgatctctaagcggagctggaatatttcctagatcatttgcagtagcgataaacaatacttttgataaatcatatggttcttccaaataattatcagagaattgactattttgttcagggtctaaaacttcaagcattgcactagtcggatcacctttatagtcacttgacatcttatcgatttcatcaagtaagaagaccggatttattactcccgctttcttcatcccttgaataattcttcctggcatagacccaagataagtacgacgatgtccacgtacttcagcttcatctttaactccacctaatgatgccttgatgaattcacgctgtagtgcacgggcaatacttttagcgattgaagttttcccaacccctggtggcccagcaagacaaataattggtgcttttagcgatttagtcatttgtttaaccgctaagtattcaacaattcgttcctttaccttttcaagaccataatgatcttcatttaaaacatcttcaattgcttgaatatcttcaacatctttagtttcttgataccaaggtgttttcatcatccagtcaatatatgttcttactacattagcttctgaagaagctgctggcattgtttcaaaacggcgtaattcttcttcaattttatccttaacatgctgtggataaggatttttttcaagttcttcacgaatcatttctgcatcgtcttccttcggtacactatcacctaattcctctttaatagcccgaagtttttctcttaaatagtactcacgttgattttcatcaatactttcacgaactttacgattaatcgtttcttcaatttcacctatcactttttccgattcaattgaactagctactaataataaacgttcattgatattaatagtttctaagattttttgtttttgattaagatcaattggtaaatattgtccaattgtgtcagctaaaacacttgctgatactccactagttaatcgattgattgaatctagcggcatatttggcatactgcgttttgcttgttcaaaatacgaagttgtcttacgaactaaagcaacttcttcatttcgatctccaaattcatcttcaataatttcaacagttgagtagatacttccttgttgttcttcaaagttagtcagcctaactctttttgcccccaaaacagttaatttgatagttcccgaactgtcacggcgcactttacgatcaattttacaaagagttccaatatggaacacatcatcaaaagaaggattatccactaatggattgatttgtgagacaaaaatgatattgttatcatgttcattagcacttaattcaagtgcctttaaactcactggacgaccaacatctaatgttaacctgttttctgggaaaacaatcatgccccgtgtacaaactaccggtaacgttaatacagtttgttcattcattctatttcctcctatttcgctattttactaaaaagacgcatgagcgtcttttcattattttaagttgtcttttactaaatcaacagctttacgagttaacaaatcgttttcgatacggctcatatttccttcgaaaattttcttaacttcgtctaattctttttgataatattcagcaattgtttttaattctgtttctaattcttcatcactaactgctaatttttcttcttcgataattgctgcaagaatagcatttaatttcactctttcttcagcttgaggtttaatatcttctttgatatcatcttttgatttaccagtaaattgttggtaaacttcaaaatttaacccttgtctttgtaaattttgttcaatttcttgtaacattaatccttgttcttgttctaataaagcatcactgtcttctactttagaagacgctacgattgctttatataaatcatccatgaatttattttcattttcagattctttacgagttttaatattagctttgatatgatccttcaattgatctaaagtttcaacaccatcaatatttacatctttagctaattcatcatcaatttctggtaaatgtttttctttgatttcatgtacagtcactttgaaagtagcttctttaccagccaaatcagctgcaccataatcttctgggaaagtaacaacgatatcttgttctttatctacagtcattccaatcacttgatcttcaaatcctggaataaatgaaccactaccgatttctaatggatagttttcaccttttccaccttcaaaagcaacaccgtctacaaatccttcaaaatcaattactgcagtatcacctttagcaactttcccaccttcttttactgttaattcagcaaattgagtttgatagtttgctaattgttcttcgatttcttttttagttactgtaacgcgaccttttttaacttctaatcctttatattcaccaagctcaacttgtggttttactggtactaagatttgaacttccaattcatcagcatctactttttgaacacttaaagcaggttgtgctactggttcaacatttgcttcagttaaaatttcaacaaattttgtttgtaaaatcatatctgttgcttcttctaaaacactagctttagaaactcttgctcttaccatagctgcaggtgctttacctggtctaaaaccatcgatttttacatttttagctaatttatcaagtgctttttcttgagtagctttccattcttcactatcaaatgctactgttagttctacgattgcattttctaattttttattattgattttcatactattctccttttttagtttcatcacgtattatatactaacaatactattaattcaacttttttgaacaattaatcttgcaatttcagtactttaatattcaatttctttaatttcatttaatttttctaaaatttcttctttatcacaattataaaggtactcgatatcatctaattcaatgtcaatatactgcatcgacgcaatatgataatgaattgctgcagcaattggacgataatcataatcatcgatatatttaggataaactaaatatagatagaaatttagaaactgctcacacaatgaatataacgaaggattatcatcttcaattccttcagataaaagatttaagatcgttccaccaacttcttgattcaaaactaatggagcataacttggattaattccatattcaatccccttttttaccaaggtcatttcttcatctatttcttgatcaatcatcaattcaatgagtaaactcttagcgaagctaggcttattttcatctttcaaaaaattacgaatagctggtaataggcgccgaatattaattccttccatttgttcaattgccatatacaataaatcctcattaggcaaatctttcatcaaaatattttccatatcatccaaactaaaagcattattatgccgttccattccctcgtttgcttcacgtttagctaacagcagttcatcatgagcagcattaaagattgcttcatattcatacggaatatatggcattgataattcttctaccatgatattgattgcttcttcaaactcctctagttcctttaaagtagccacataaatacttacaacatcataataggtattacttgctttcgcttttgctaacattccttcagctttagccatttgatattcacctaaaccataaagacaaacaagacgctgataccgcgtcatttcgtcatccatatcattcaatagatcaagtgcatcttgaaattgattattagctatatattcttcaatcatattttctccttaaaaatgatgtatcgaggatacatcactattcttcttctaaatcaaattcataatccaagacatctgtagtttcttcttgttcttggagactttcaatcacttcattataaagttctaacttactatcctttaaaaaatcatcatctgtcaaaggcataatcatcactccttacaaacgtaattatagcaatactttatcattttgcaatcgaaacacctcaaataattcttcgtagtagtcattaaaaacactatttttacgccagataaaattaatatcatgttttattgttaaagcatttactttgacttgcttcaatcttctttcagctaattctttttcaacagctaatttatagataaaagttattccatgattatttttaacaagacgtttgatcatattaatattaccaatttcaataatattactaaaatcatcaatatctaaattccgctcttttaaccatcgttcaataatttctcgtgaacctgagccattttcacgaataattagattatacttaaataattcactaatatcatggactattgacaatggaaaatcaattgaaccaacacatatatattcatcttgacaaaattttcgataatcatactctaatttattaaagtatccttcaactaaagcaaaatcaagttgtccttcattgatcatctttaataactcacttgtatttgcaacctgcatcttaatcattgtgttttgattttcatttaacaattgatcaatcactttaggcatcacatattcccctactgtaagtgttgctccaaaaaccagctcttgtttcaatgacaaattatttaatttatttttcaaaaaaatatcatcatgctttaatgttgtagctacatcaagcaaaatttttcctgctttagttaattgcatctttttaccaatatacataaataacttaacatcataatattcctctaaataacgaatatgacccgaaacagctggctgagtaatatttaaatactgacttgctttagtaaaattcatatatttgcataccgccaaaaaagtatcgatccgaaaatctaacattaaatcacctcattataactataacatattattatcgttatataaatatatataatttttatttattgtttgatttatgtataataacttcgacaaagggggattagaaatgtcaaaaataaaaaataatgctttaggagttattctatgtctagctattgcaatgccagcatactatctcggtaaacaactgccattgattggcggtcccgtatttgccattttaatgggaatgatcattacattcttagttaaagataaaagcaaagttcaaagtgggatcacatatacttctaaaaaaatcttacaatacgccgttatattattaggatttggtatgaatttaagcgatattgtaaaaacaggaagttcatctttaccaataattatctcaacgattgcaacttctctagtcgtagcctatgtactatgcaaagtattaaaaatgccatcaaagatttcaacactgatcggggttggttcatcaatttgtggtggttctgcaatcgctgcaaccgcaccagttatcgaagctgacgatgaagaaatcgctcaagctatatcagtaatctttttattcaatattcttgccgccttaattttcccaactttgggcggtatgctaggattatcaaatgatggttttggactttttgctggaagtgcagtcaatgatacatcctctgttaccgccactgcaactgcatgggatggtattcatggaagtaataccctagatcaagcaacgattgttaaattaacaagaacactagcaattattccaattaccttagtattagcttttaaacgtactcgcgatgctgaaaaaagtgaaagtacttttaatctcaagaaaatttttcctttctttatcttattctttatcctagcttctgttattacaacagtcttcaacctgcctggtaatattaccgcaccaattaaagatcttagcaaattttttattgttatggcaatggcagctatcggattaaatacaaatattgttaaacttgtaaaaagcggtgccaaaccaattttcatgggattttgctgttgggtggctattactgtggtttgtttatcaatgcaagcactattaggtttattttaaaatgacgaatattcgtcattttttatttttaaaacgccaagttatttacccttatccatctagacaagcaatatatgcgattaatttcaaacgctctggatcaattacttcatttccatatgcttcataaaataaatcaccatatttatcattacctagattataagcaagtgaccatcttccccaaaacaaatcataatggcgatcacctactcccgcacgtcccatatccaaaaaaccgcaaaaacgataatcttggtctaaaaaaatatttggcaaacaataatcaccatgaataactgtatcttcaactaaaatatcctttttagcattaatataactaaacacctcgtcaagttctaagcagccaataccttgtgtcatttgctcatctaagttggcttgttgataatttaaaaatacacgttttaatatttcttcattatgatttatatatatagcttcagtaaattttgtatcatggaactttcttaacagctttcccaaagttactgctaatatctctggattagaaattagttttggggcacagctgcacatacctgacattctcttagttaataaataatctcgctcactactgctatattctagcgccgcttgactgtaattatacttactaaaatatattaatgcccgatactctgcctctaattcatgtttttttccaatttttaaataataatcttgatagcagtaggttttggcaccagatctcccacttgtatctaaaaatagttcgggagattttctaaataactctagcaaactcttaatatccatataaagatcacctggtatattgtaattgactcatttaatagtcatctacaaatataccttctcctttctatcaaccatttaaaccggttttttatttcgcatacttcgtatgctcaactgacttaagtctatatgttcaaattttcaatttgaacaggtaaaataaaaatccttcattggtagaatgatatcatctaccaatgaaggataatttacacaaattattttacaggctctttcatcacaaaacttctacccttatttgataccaaacccacaggaaattaaaatcaattcaaaacatacccctagtttaaattaaagtatcaattgttcttttctctatctatctggatttaatttataagccactatttaatgaggagagagttatttttccagatagttatctactatcagtaatattttctttttaatattgccaatatacctattgaactaaatatcccaaagaaataattttgtattttacaaacatcatcagtcgcaatcttgttattagtagatgtttgatttttcttttctgcaattaagctatcagtatctcgatccaattcatcgtcctttatccatttcggataaattattgtatcttgggtaattatttgatcaaaatcaaataattttgtatattcttgatcactataccaacccataaatacataaccatctttttttggtaaggcaggccgaactactttttcaccttcttctaccttcatttcaatcccatcaatatttacttttaaaaccttagcccacttagtatatacagttatattagttaaaatcgaagcattgaaatcaaactctttattataattttgatcactataccaacctttaaaattataaccattttttgtaggaatttcaagctgtggtaaatttgttcccttttctacaataaatacatttccatcaattattacattaaaagtttcaacccatttagcatatactattgtcttttctgtaatttgcttattaagatcatatggcattgtacattctgaattggtataccagcctttaaatgcataacctttttttacaggatcgctcattcctgcaagagtatcaccatattttacatttacctttttcccatcaattattacttcaataacatcatcgacatattcatcacttggcaaattacttttcgttccgtctaattctggtaaagtatacatttttggatttcctaagttacgatataacactcctaaatctgtcaaagagccaactgtaagattattatttttctcattgtcaacctttgtattaaataatcctgagtcccccccaaaacgatctgacgcatcaaatgaaaaccatgcatatcgttccacgaaatctaaatcttctaatcccttgatatcgtcaaaaccattgaccacatactccataaattttcttacttctaccttattttcaatattagctccattataaccatcccaataaggatcccaatttgccactgcgaattcggtgacccaaatcggctttttgtattctttatgagttttgactactaattgtaaaaaatccttagcattatcttttatctcactatcagtattaccaatgtatccaggataattatggatcggaataaagtcaatatcatctggattaattccttgccaataattattaaaccactcagaatcaggagtaccatttgctgttgctggtgccccgatacgtaaaccactttcagtaaaatatttttgatttgtaatcgctgtttcgactagaacgtttgactgatctgcaaaatctggttcattataaccaagaatagttttatacccagcattctttatttcagttatcttatcattagatccctcataagctccccaaatcattggtacataatctaactcagcactcaaatcaccacttggacatttaccagtataatcgggtgctgttccccaattataataccatgatatccccatattttgagcctcttcaattgcgctatgaccagcactgctatgaaatcccaatccctttttagaaacatagaaatttctaatacttgtcgaaatttttgtatcatcgtttaaaacagctaaaactttaatttgatgctgagctacttcagtagtataaacctcacaactataaaaagtttcgttatcaacaatattcactgtttgtaacttaccatcaagataaacctcatatttcagtacatcaacacctgttaatttttcccattcaatttcaatcggacctgccggaaccaattgtccagcttcaggataattaactgcttctgttttccattcatcaaatggatttatgccagcttgatctgataatgcataaagattatttggactaaacagcagcactgcactaaatagtgcaagtgctgaccgcttaacaaatttaatttttttcataagatcacctctaacgatgaatacgtctttttttcaacacagctagaccaccaactgctagaattcctaacatcacgtaaccttcaactattttttcatcaccagttttagctactttataattgtttactttactattatcaggtgtcttgaccggctgattagcagtttcatcatttggtgtttgatcatctgggataactggtttttgcggttcatcggttttcaaacgtaatcctttgatagctttgtctagctctttagcttgttgatcaacaactgcttgatcaggaatcatatatgcatcactaaacattttagcattagcatgaactgtattgaagactgcaactgtttcagttgtataacgattattaatataattttcaccagcaataatttgaagtgcttgttgtcttaatgcatttaattcttcataatctgccggttttaattctaagctatttatagcattccataaatcttgataagtttgatcaattttatcttgatcggtaatgtctgcatcttttataacatttctagcttgttgcaaataatctaagaatttagctacattgatataatattcattttggaaatattcaccgtctctaatttttacttcagcaaacttaattaattcttcaagatcaccagtattggccggcattaataataattgatcgactccattatgaatattagcagcacgagcttcaattaatgcttgatttcgagcatctaatccttcagtttcgtacaattcttttcctaagttgtaataataatcaaagatttctttcgttgcttcaacatagttaccattttgataattatcacttgctataatcttatttgcacgttcaattgcaatctttaatggctttaagtctgcatctttaatagttaaaccattaatactatcccacaatttttttgctgcttcatcaattttatcttgatcagatgctaataatggattattatcacgatcatcagctaactttttcgctgctttataagcattatcaaatatttctttagattcttttgtataaaacaagctagtataatcagttgttttcattatacgttttgcttcatcaattgctttatctaaatcattatagtttgcagaagaaaattctaatgcattatatgccgctttaatttgagcagccttatcatcaacttcatcttgtgttaaacgatttgggatatatgctccaccagcttgttcttgtttaaaattatcataaattggtttaatttcatccataattttcttatattgattaaatgtttcttctgtgtaaacatcaccacttgtaagcttatcatcacaagcttcataagcaagaattaactcctcgatatttacgtcacctttttcattgtatggatttaatccattttccactacaggatcttgaacggtaccacgattacatacaccattttgataatttaaaatatatttacgactccatccttcacctttttcacctgttaccttatcaataccactgctgacactttcaccacagtcattgataatcttattaaatttttgtaatgccccatctgctttagcaaaagtttgtgtacatgcattttcaactaataccatttccgcatttggaacttcaattggattatctaattgaatttgaacctcactagaatcataagttggtccagtataaataaatacattgtaaattcctaatcctactgcatagtgttctttcaccttattagatactttatatgcagaatatccattagataatccttcatgtgacatccaagcactttgtgaaattggatcataacatttttcattttgatagaaataagttgctcctttttcaccgttccataaagtatcatatttattaaaatgttcattgaatagtgcataacacgtaacattatcaccattaacaattactccatgatatgactcatttccataccactcaactcccgcaccatgatcagcacgccaaatccagaaatgatcaccaattacatcattactattgatttctaaggcgatatcagcttttgttaattctgaagtagttcccccaattctaaagaataaatcttgtaaaaccgttggattatcactatgatctttatcagcgccactttcaccaacttttaataaatattgagaatgtttacccgcatcaaaaattaatccggcaattgttactccgtcaacatcagcaacttccatcgccgcctcttcattatctggaataatagtagccattcctgttcctaataaaattgtatcaggattatttactttaattacttcttcagcatgatatattcctggtgtgaagaaaatatttttacctgcttctaactgctcattgatttcagcagctgtattgctatcatgagcaataaagaattcatctaaacttaaggtttctccttcccccatatcatcttttgaccagcttataccagaagtgttctcttttaaagccggcacaaagaccttatattcaccatcatcaataaataagaatggtttttcttttgattgtggggttgttgtaatattagtagttacaccattttcagcccaatcagtatatccatttccttgaactaaagcagttccatttttagaatcaggtaaacttgctgaatcaacaccaatattaaagttattcaaagttgttcctgtaccgcttcctttaataacagtatttctagtaaaatattgttgtcctgatgcagttccagcatcactttcaaaataactatcagctgtatatccaccagacgcccaaccaaatgcccaatcataacttacttttcttgttgaataaacccttcttaagggtgcagcctgagcgactgaccaattaaaataatcttttttactattatctgtagaggctgataatttatcagcaactgatgcatcaccctcaccaactaccgaaatattttctgcagatcgccagaaattacatgttgcatttctccattcaccagtatcagcccaatgattgtcacttgttgcactaccatctaaatatgctggtacctcaatgttatttaattttacttcatatggtgttttacccaaaccaccaatatgagtgtagaatcctactggaatacattgagtattaacataattccccggtttataatagattgcataatgaccactgttgaattgtgcatcagttgtaatgtcattttgttttaagaaaatctcttgaacaacttgatcgattttgtcaactggatcagtttcagcaaaaataatcatatttttaccaaaaatagttgtttctaatgatgaatattcatcagacaaaggtgattcaccatttgcatttttagcaactattttataataatttgaatatttattttcattagtatttttatctaaataaaagttatcggttatatcccctgctattttttcatagcttgcaaaagcacttacagcacgataaacatcataagaatcggcattattaactttagcccagctaattttaatattttcaccatcttgaagcgtttttagttcaattggctgtactggtgcaggaccatttttagtttgagcactaatttcttttgaatatccaaaattatcttcagctaaaattgtaacaactttaaaaagatattctgttcctgatgccaagccttcaataaccattttagtatctgttgtaatcgcactcttaatttctgttttaccagttcctacgttagctggagttgcaaccacttgatacccagatactacttgattcactggtgctttccaacttaccgttgcatcactgtcactcaccttaacagttacgtcagttacagggttaggtgtcatttcactatgaataataaatttttcattatccgttaactctttaatatcactgcgaatcatctgatcattactattgactgtaattattttttggtcaacagacgacatgaatgaaattgttccatccccatttggttgataagcaattgattcccagcctccgcatatatcaccagcttgttgtgtaacaatttcacttgatccagagttccagcaaagatcaaatttttttgatttaaaattaataacatctaaatcattgaatttaccaaatctaacatcatatctcaaatcatcaccgataatgtcattttcctttacaccatcaactagtaaaggggtaacagcttcacctgtcattcttacatattttccactggccttgtgttcaatataataagtaaaatcaacaacagcaggattttcaagaaatttaaattctaaggcttgattttcatcaactcttaaaatctcaccattactgctatcaatcccaaaatactttcctttatttgtatccctaatcgttcctgtattagttcctgtagcctttataatatattcacattgatcagttcttttatcactatcagcaaatacatatgtattatcgccttcagaacgaattggatattggtcatccaaaccgacactataaatatttacacgaacttcatcagctgccaaaccattttgatcggctgttttgacaatttttaataatgaattttgatttactttatttccatcttcaacatatgcgccatcaacagtcgtatgagtcgtccatcccggtttactaacattgactgctttattgttctctgtagatacaagtacatatcttgaatcatcattgatttccactggtgtggcagccgcttttatagttaccggatttaacattccaatagccatcgcaatagttaaaacagttgcataaactcttttgtttaacctttttatcatttcttttccccttctttatatatttatctataaacaaactttaaattgtattaaagtggccaactccaatacaatttataacaattagaatgttaaataaatatttgcgcgtaaccactatttaacattcatcgcaatgtactaaaacattacacttttaaaataacatagtttttaacatgtaaaaatagatttgacgagttatgtaaactgttacattacttgtaacaaaaccagacttttcttcactaaaaattttttatcttttatcttacaaaaaaacatctggcaataaatgacagatatttataaatttctacttgtaaattttaatggtaatgttttttcttttgcattttgcaattctcgtgttgctctttcaatgatataaagaacgggaatttgcgaagatatattatatgtttgcggtaaaataatatctttaacataatagtagattcccaaatctgccatttgatcaattgttgaccctggcttgttagtgattaccacaattcttgtattctgactttgatacattttaagctgatcaattacttctcgagtttcaccactttcagtcaaagcaattaataatgaactttcattattatcaactgccggaggataataaggatcatcgatactttgtgaataataccctacgtttgaaaaatatcgagccccatattttcctaaagtaccacttgttccaattcctaaaaaacaaatcgacttagcttccttgatatacttaacaaatttattaattttctccttaaaatccacacttcgtgcatagttaaaaaattctaaaagaacatcaatttcatcatcagtttctggtagagtaagtccatcattaaataactttaactttgtcttgaattctacaaaaccattacaatccaatttttgacaaaaccgtactactgtcgccgttgatacatgagtacattcagccagatcacgaacactcatatttgtaacaactttaatatgcttcattacataacgataaataaatgtttctgtttcattcaaattagcaatttgcttgtatgtaaacagcattttatcgccccctttttttgttggatgaatctttcttccctgattatgtataattctaacacatatatccaccaaatttaagagtttaaaatttatttattaactaaaaacggtctaatttaagataccctgctttaatatagtttaattttctaaaagctttataaattccaaagctgatcaacattggtgttagtaaatcaataacaatgattggaatccaataattatttcccatcacattaacagcttctaaaatccctaccagtcctgcagttcccattcctgaaccaattgctgaacaagatatttccaacaaacaagtagaaattggagcaataatagcacttgttaaaatcggcggaagccaaattatcggatgctttacaatatttttaaactgcaacatacttgttccaatgccaattgctacaacatcaccaatatcattatcatccatcgacattaccgcaaaaccaatcatttgagcacaacacccagctaaagcagccccagcagctaaaccattaagtcccaacatcactccgatcgccgcactagatatcggtgctgttaaagccattcccatcaaaactgcaactacaattgacatgaaaaatggctgcatgtttaccccttgattaattaaatcaccaatccaaacaattaatttagtgatatatggaccaataaatattgtcactattcccgcaactataatagaagtaaaaggcactaacaaaatatcaaccggtgtttttccttgtactaatcttgttacttctactgcaataattacggctacaaacgctgcgattggatttccagttgtcgccgtattaccattaaatgttcctgctccaatcgttccagcaattactgccgcaattagatttaatcctttagcatcgattgcataagcaatacctgctccaatcgctggtcccattaaataagttgccacctcaccccaagcagctagttggctaatattagcaaaatttcctatttgtttaaaaatcgttccaatgatcaaactgcagaaaaagccatatgccattccatttaatgatttaataatatagttatcttttttcattctaacctcctacaactgcaatatttttaacccagcgttcttttttaaagaagtaggttgcaattattaattttatcaaatccaaactttcaacaacgatatataacgaaattaaagaaatagtcgtaaatgacgataatagagttgaaaccagtactccagcagcccacaaaaaacctgaatccataatcatcgtactaacaacatctccacccgcccttaaaataaagaagatgcagacattaaaagcatagatattaatcattatcgatttaattcgaaccaatcttacgattgcttctttaattggtatatcaacattatacagattaggaatcagtggtgccaataaaaaacatatcatcccaatcattaacgataccatcaatgcaaaacataataatttacgcgcattatctctagcctcatcaagtttattagcacctaatttatttcctatcatgatcgacacagctgaagatagaccaccaaaaacaataaacattatattagctactgtgtcaacaacagatatggaagccactaaatattcgtcacatcgcatatatgacataaaaattaaagcttgtcccaatgaaaacaaaatttcattgatcgtcaaaggaattgctttacgaacaatactggttaataagttgacattaattctaattatcccttttaaatcaaaactaaagaaatgtttatttcgatataaaataatcaaatatattgccatttcaacaagtcgagcaataatcgttgcaatagccgccccttgaattcccattttaaagaatccaaaatttccaaaaatcaaacaatagtttaatgcggtattagttattactgctactatccccacttttagctgaatcttgttaataccaactgctcgtaaagccatcatacaagtgaacgaaacagcaaaagggatatatgtatatttagcaagatgtaaatatttaatcgcctcatcaactataatcggtgttttagaaaacaattcaattgcgtattgaggaaaaataaaaattattaatgtaaataaaagtcctgccccaaccgcaaaagccatattaatattaaatacctcttggcaatttttcttctgcttagccccgaaaaattgagcaatatagattcccgccgctccacataacccaaataaaattgagttcataattagaaaaaaacgatttgccaccgttactgaagttaatgcaatattgccaatactgccaatcattacattatcaattaaatttacaaacgttgtgataaactgttgagccataattggaaaagcaatactaataacagttctatagaattgtttagttccaaaatatttcttcagcatcatcactcatccttttttctctttaataaatcagggaacgcacgtatcaaacgccagtgcccatatttaaacaacttcttttgtctaattaatgattttaagacgatttgctgcttttgccattctagacgctgtttttcaatatatgcacgtgcttcattttgtttttcctcaatatttgcaatcaatctattttcactttcttccagtacttgttttactaattctaatttcttttcaatatccaatgctacatgtgttgatacaattgtatcaacaataaagagaactgataaaaccccacttaagacaaataaaatattttcatcaactaataatagcttactagtaaaaaaaggctgaacataatcgattgccacaacactaaataaaccaaaacaaataaaaccctctaaacaaacacgaccattcaaattaaaagccttttggctataatcccaccagcgtcgatggaacagtttctccattacatacgaagtaatatattctaataaacaagctactaccccgccactaataaataaagtatagataggataattaacctgctgaatatcaaataaaacaattaccagcattgcaccaaaaccataaataggaatccagggaccatttaaaaaacctcgattatatggtttttgatgccgtgataaaggcaaaatgattgattcccaaatccaccccattaaacaataaataaagaatgaaaccacaagaattatcaactttccagtcatattttgcctcctttaaataaattaaaaagtctgccaaagcagacttaatatacaattggtggagcctagcgggatcgaaccgctgaccccctgcgtgcaaggcaggtgctctcccagctgagctaaggccccaaaatattaaaatatatatggtgggcctgaatggatttgaaccatcgacctcacccttatcaggggtgcgctctaaccaactgagctacaggcccatatatatctatttgcaattaactaatggtgggcctgaatggatttgaaccatcgacctcacccttatcaggggtgcgctctaaccaactgagctacaggcccatcaatcaactgccctaatataatagcatgtagattctttaccgtcaagcatttatttataattttgacaattttttttatttcttaattttatcaaaaaatcgtcattgcatattatttgtttgcatatctaaatattgttatactttgattatagtttatatttaagggaggcaattatgaacttatatgaaatagaagtattagataataacaatcaaacaatctcactaaataattataaagatcaagttttactaatcgtcaatacagcaaccgattgtgaattcaccgagcaatatgatgatttagaagaactttatgaaaaatatcataattatggtttttgtattctagatttcccatgtaatcaattcggtgaacaagcacctggaacaatggaagaaatcatgtctttttgtgcggatacttatggtgttagttttccgcaatttgctaaaatcgaagtcaacggcccaaatgaatcaccactttatacatatttaaaagaaaaacaagatagtactttatcaaaacgaatcgactggaacttcacaaaatttttagttaatcaagagggtgatgtcgttgcccgctttgaaccgttagtaaagccaagagaaattgaaaataatattaaaaaattattaaaataaatctttataacaacatacttgcattgcaacataataaaaactactaaattgaatgaacttattattttaaatcaaaaataataagttcatttttaatattaatattcatcgtatctgatacctcatctttaagataagattcttgtatattcctcttttaattacatatattattaaaggaggtaataatggtaaaatttgcaatttatacatttttaggatttattcttgagtcagtatatgtttcaatcttaaagaaagaattctatctatcgggattactaaaaggaccgtttatccctatctatggctttggtgcattattgattttaagcattgtcccttatcatactaataattttgaaatctttttttattcactattcggctgtactgccctagaatatttgactcactttttcttatcatatgattcacaaatagaagtatggaattatggtaaaatacctagcaattatactagccgtatttgtatgttctatagcttgatgtggggatttttaggaattattttagttaattacatcgatccatttattaatagccttctaattaatttaaattattatgctgttaatattattgcactcatatatatccttataatcctatatcaattttataatcagcaatttcaagtaacaaaaaagcagcctaaataggttgcctacatattagattctcttttttctcatcgcatcaaatgcttttaataaaattgccttaacatcaaataaagcataagcaccaattccgattatatcaaccggacaacgtactaaacgctcaattttaatttgttcaaaacaaatcaaaggacttaacaagacaacatcagcatcaattcggttttctaatgcttcagcaattgaataagcttgaatttcacattttacagagcctttttcagattcttcaatcagcttttcaacaaaaaaatcacttggtatttctgtatcccacaataaaacaatttttttcatcttgctaaacccctttcttttatattttggtataatttgttgtattttatccattaatttatcacattaaaaactttttataagcaaaaattattttttatacacacaaatatatcatttacaagaaaagatgtaaatgctttcattactatttattatatttttttattgtttttgacaatatattttattatttatatttaaaaaactcctataaaatgaagcacacttccataactcagccaactaaattatagagtgtacttaaaaaaggagtttttctacgataatatcttttcataatcctttggatcaattgtatcttctggatatttctcacgatatttttcaatcccatcacatattttgactgctaatttttgatgatacttactactttgcagttgtcctctttcattagcattagagataaaaccacattcaatcaatactccgactgtctgggttgcccgtaaaactcggaaatctgcacctgaaatgcgttttgcacttcctgtaacttctttcatcgtagtttgtatttcactggcaaggcgctttcctttatcactgtttttataataaaatacttgggaaccccaagcacctgaggctggagctgagtttaaatgaatactgattaaataatcacttttatatgaatctatctttttaacccttaaatacatatcatcctgttttgaatagtgatgatttcgtttggtcatatcctgctcgtcttcacgagtcatatttactgttgcccctcgactttcaagttcttctttcaaggcatatgaaatttttaaatttaattccgattcataaatttttccaacacttgcaccattatcaaggcccccatgtccgggatcaattactactgatacattttttaatggtaaatctttgcttacggccacatcatttttaggataaaaataatgtcccgcaagatacaatgctgctgtaatcgctattataagatacgttctcttcacaaaatcacctaacaaattatatgcagtaacgattctaataatgctaaaaacgcgtaaaactaattacacgttttttaagtatttatctataaagatgcgaataaagtgaaaacacgtcatttaaaatgatgtatttttatgatcgtactttagcccaaagttcaatataacaattttcctgataaggattataatatttttgaaccagaagatcatctggttcaagacgatgttcaacaaaccaaacttcatacaaatatcggctagccttatataaagcttcattcactaatgattcaaaattttctgcttcataactacatactacatacttaccactaggaataattcgttgttcacaatcaattgacggtctatcaatttcaatccctacaaaataattaaataaggcaggatcatcactcaatgttaaaatatctactactaccgcatcttgaacatctaattcctggtacaaagaaactatgttatttatcttcggttcacctaattcatctactttagccattttgcttttaccataaaaaattcgatcattacaaacttgtttttcatttatctctaaaaccatcccttctacgatcaatggcacgccagtatcaattacaacataattaagctgtaaatctggtttaatgaaatgatctaaatgaattttttgattacgataatcatctggtgtaattttatagacttctttaaaagcccgagtaaaagcactatgtccagaaaaaccacaggctattgcaatatctaagattcttttttccgtattttttaattgattggcagctttttctaagcgccgcagcttcacataatcattcacagtttttttagttaaacgaaaaaataatcgctgatagtagtattttgataaatgagcaattgctgctaatttatcaatatcaatctctttatcataattttcttcaatataatcaagtgtcacctgaatctcttgccatgcatacatatttaataacccctttcttaagttacttatagtctaccaattaaattatctctctgtttatctgtcaatgcctttattcacaaattagagttaaataaatttttgaatgtcaaaaaatctttatatctattaactttatgtgattgatttgtgatataatctataaagaatacattataggaatgtggtgaaaatattgatttgggatatcacggcagaacttgtttcagcaataacattatgcattattttagtctatgcccgtaaaggaaatcttctaccaaccgtaaaaaataaagtttttcagtattgtttattcattacttttctttcagtcagctctaatattatttcaacaacacttttacaatattataagcaagtaccattattctttaatagcttttttctactaatttactatttaagcacaccgttaatgggcgctatctatttcatctatgcactagctaatatttatgatgaaaaagaggtcaagaaatatgctgcactttgcagtttaccatcaatattatacgttcttttagtttttagtaatttctatacgtcgttgctcttttcgtttgatcaagtatccggttatcaacaaggaccttggatatttattacatatttagtcttttatatttatgtctttttttcattgattctagtaattcataaaaggaaatcgctcgaacgaaatgtaagttatattttaggggtattcccttttatttctgcctttgtaatcctatttcaatatattcaccctgaatatattttaacaggtaccgcagccactagtgctcttttaattatttatttgtatttacaaaacaagcaaatgttcacagacacattaacgaatttgttgaatcgtcaagaattcaacaagatgatcgatatcttaatcgataataacaaaccttttattgctgtagttatttctttaaaaaattttaagtttattaatgataaattcggccaagaaataggtgatcaaattcttttagaagtttgtcattatttacgttatttattgcctaagcaggcaatgtatcgctatggcggagatgagtttgcattaattttttataataaaaagaatgtaataaacgctctagaaaagattgaaacacgaatgaaaaatccatggcagatttcaaatattgactttatcattagttatgtagctggaggaattgcttatcctaaagttgctcatagcaaagaagaaattattaacggcctagaatatgctgtttcgttaggaaaaaaggataatgctcataatattaatttttgtgttactgcaatgatcaaacaaattagacgaaaatatcaaattcttgacttattaaaaatttgtttagaaaacaatagttttgaagtttattttcaacctatctatgatctcaaaacacatagctattgcaaggcagaggcattactccgtttaccggacaatccacttgggtttatttctcccgaggaatttattccaatcgctgaagaaaatgggttgattgctccaattacttatcaggtacttgataaaacttgtctttttataaaaaaagtgattgctgaaaaaaaggattttaccggtgtttctattaatttttcagtattacaatttatgcaagatgatcttgaaaataaagttttaaaagttattgaaaaacatcaactgccttatgaattaataaaaattgaaattaccgaaagtatgctggtaactaattttgatgcaatcacaaattttatgacaaatatgattaatcgtggaatccaattcttactagatgattttggtactggttattctaatatcacctatgtccttactatcccttttcaagtcgttaaagtagataaaagcctaatctggcaagcaatgaaagatgagaaagctgcaattcttattaaaaaaatgattgaagcatttaatcaaattggtttacatatcttagctgaaggaatcgagacgaaggagcaaatggaatttatgaaaaaatgcggctgtgatttattgcaaggttattatttttctcgaccagtatcatttgatgaagctttaaatgtaatcaaaacaactaaaattaccgaaaaataatagacatggttgtctataataatgacccgatctcattcattaagtccaacgaatgaggagcgggtcactttttcacacttatatccttgatgcctttgataaagcaaacataagtgggattattaataaattgatcaaacccctgctcattgtcacataaatatcttagtgatttcaataatccttgggttctaacatttccttcaaaatcatcttgtaaagtcgaaaaaatgattattgatacttttttcttattatagataatagggttttttagtacaaatacaattaatagattttttaaatttaatttcatatgactcgaaaaaataagactatggctacatgaatcaataatctctacttgatctttgtctagtaagtttttcttaaatatatcaaatgaaatagcgacttctttttttaatacactatagagataatcgtaaattccattgatattatcaatatcaacacaattaaaataatatttcttattaaataaaaattcattcatttcgatttgtcttgtctccattacaagatttttaaagtatctcattgtattgttatctaaaaactcagacattaaaacaattgggatattgatatcaatatccattgaaattgttgaaatgatataatcatattgatttatgtcacactctaaaatattacctacattaccaaatagttcaatatcaacatacgatcctatatcaaacaataactgcctatataataaatctctattttgatgatctagcgtacatacaaataaaactttctgtttttggagttttgttaaacaaatgaacttttcgaacaaaattgtaaaagacgatatactgctcatcgaaacatggtggattgttttttgctctattatattcttgagacataaagcaagttgaaatgaattggagtaattcttctcaactttattatagtatgtattacgctgttttgtattaaaactacaatgaaacaatgtcttatctaccatagtaaacaattcttcctttaaatctttcaaaagcggttctttaaatataataaaaaactcattttcaattgcttttaatgattcattgacaatcgttaaagacatttctttattataataaaatgaccctttatcttctttagcaaacaattcaatagcaatttgtttaatctcatcataggtaatctggcaatttatagtatctttaatttttaatgcaatctcttttgcaacttgcatttcaatagataagttaaactcttccggaatatcaatttcagttaataaatgcttagatttagctcttgaaatcattaccaatatgtaaacgaggaaatcaattaaagatgtatcagataaagaaacattatatttttttaacaatgatataatcttataatctaacatctctttatttttataaaggctctttaaaaaatcaaacataatatatgagtgcttgtaattaatgaaaataatatctgataatataattcgtttgttttcttcacgtccttctaaaatcaaccctacatttgctttagagtttattttcagttcatgcttcgcaaaccattctctaagattagacagttccttagataaagttgatcttgatacaaaaatttcttctgcaagatcatctatcttaattcctgtgtcgcattcaaggagtcgctttgcaacataaaaagttctatttatatatagatagtaatcaaaattatggttacgctcatggttttcaatcttgttaataagctctagtgcctccaaataatctgtaaaatctatacgatatcctttaggggtacgtgaaatcaatcgatatccaaattcatttaataattcttgcacattaataatttcatctctaactaatctcctacttattccaatatgatttgcgatttcataagaggttgcataatcatctaagaaagataaatatcttataatttgaatacagtaactttcttgattaaaaatttgagctctaaccataattaatcacctcactaatactctacattattttccaaatcattaccattgcttgcaatacattttttataccaataaaatgatttctttggatatctctttaggtcctttaaatcttcaacatccctattaatataaataaatccatatcgcttcaacatttctttgtgggcacttagaaaatcaatactactccaagctagatacccaataacatctacaccatcattttcaatcgcagttttcatagcttgaatatgttcttgataataatctatacgattatcatcataaattttaccattaatcatttcctctttgatacctattccattttcaacaataaaaataggtagatgataacgttcgtgtaattgaattaatgacaatctaagagcatcaggatcaattgtccaattccattcacttgcgttatataatggattttgtacaaatcctttcccccataaaagattgttttcaaaatctattattgattcatttttaatagttctatatgatgtaaccatcattgaacgataataagatatagctaaatatcctaattctttagaagccttaagtacatcctcttgttcttcattattaaattcacattcaatatctcttttttccatgaaagaaacaaaatattccggtaagtatcctgatgtcataatatcaaaggaaagataattcatgaatttatgcgagaattcacaagcaatcatatcccttgaagtagtagttgcaggttggaacaaacaataattaaccattccaccaaccatagcatcaggtatttctttttttattgctaaaactgcccttgcatgagcaacttgaatattaatatatagttgagaataaaattcttctttactcatataatcaggcctattagttccagcaaccaaatcactttgatatggagcaagatttgtttcattataagtaatccagtatttaactttatcattcattcttttagcaatacaccttacatgttcaacataaaagtctataacttttttatttaaaaaaccattatatgccctcatcagatgatcaggcatatcaaaatgaactaaggaaacaactggttcaattcccttcgataacatataatcaatcatttcttcataaaagtctaatcccttttcattagcttcatcgtcgccattaggatgtatccgtgaccaaataattgagaaacggtaagctttaatgcccatttcggccattaaatcaatatcctctttaaaatgatgataatgatctgttgcaaccttagtatcactatattgagattcaatcccaggttcaggtgtaacaacaagtgtgtcatatacatttaatccctttccatcttctaggtagccaccttctgcttgaacattgcttaacgcagctccccataaaaaatcttttcttaattcttcctttttcatcgtctttcctcttattttgtggtcatcataattatcatctgaccatcaaattctactttattatttataggaatgataaaattatctcccatttttatttcaacaccatcagcctttccacaacctttaacaaccgttgctagttgatagttattataaatatagctactcaatccacttacttctaactttgtaactgtaaatgagtcattggatatatagacagtttccttaatgttgtcatattttttttcaattggttgaacattattttccatttttgattgatcataatttagacattcaatagctttatctaaatgtaattcacgttcattaccttgagaatcttttcgatgatagtcataaaaacgataagtaatatctgttgcttgttgtatttcataaactacactcccttttctcaaggcgtgtaacaatccagccggcaaatatacaaaatcatcagatttcacatctagatatcttattagatcatcccagtgttcgtttcttatataatcctttaaatcttctggacttgaagcattatgaccataaacaatattgtaatttggcattgcttcaataaagtaccaagcctcatttttcccgctattaaaaccttcttttaaagcataaatattatcgggatgtacttgaatacttaaatcatcttctggaccaaccaatgaaataataactgggaatggttcgtttggatgaccaaacaattcttgatgactgttccataattcatgcaatgtcttaccaacaaatggttcagtaatacaaactgtagaagcgttttcttgcgcgctaaaagaccatgattgtcctataccatccgggaaatcgcaatagtcaaaataatctttgacaagtgtatgtccccatattgcaggacgaggtataggcttaaaaaataatatactcatttatattctcctttgaaaaaaagacaatttaaattgtctttaaattcttgacatgaatacaaaaagatccgctaaaattgtgactgttgacaatattctcgctaccttaactgttttttctttaatggtataacagtatttttgtgcataaaatctattaacttgggttgcttttacactatgataagcccccaataatgcaaagactagaataacaacacttaaccatagacttgtaccaactttccatgctgctggataaggaaaaacacctagtataaacccaatacacgaaactgtaattgctgggataacatatggattctttaaatcacaatatttgtcttgctttttcaaatcactttttgcatttttttcttttttctttttttctaaatacttttcttcataacttttttgttccaacttgataatcttctcgccacatattttacaaaaaactgttttgttatctatcggattcccacattttcgacaatacatagaattctcctttattttaaaataacaccaaatatatttacgagtaaaaaatacgaacttaaagccatagtagctaacgctaatcctaaattaccattctttctatatccttgtttaacagcattgtaatcaacaaaaagcgcaaacccttcagttgctaaagctagtatatagaaaacactgctaatatagaaaacaatacgagagtttccgacagtattatgaactacagttgccataaaaaaatctaaaataaccattgaaaatagaaataagataagacccagttggcagaaatagtttttttggggattctcttttaattcaacaactctagaaacatcttcttctttttttgttaattccttcccacaataatcacaatatattgcatcatcgagtatttcgttatgacaacatggacaagtcttcatcttaatttctccttttcattaaacagctacttcagtagctttctgctcttctaatttttttatttcgttcttttcatatgctttccagaacggatacatgataaccataccgattgcaaagttaataaatactaataatactgcaccaattgatccggcagttgccaaatatgctaaaattggcgaaggtgttgcccacggaatgcttataacaaatcttcctacgaaaccaattgaggttaacaaataacttactgcagcagtaatagtatgaattaacacaaatggaattgctaagaaaggatttaatacaataggtaacccaaacatcaaaggttccacaatacagaaaatcattgatggtgttgataacacagctagcggttttaattgtggtaactttttagaactcatatacatgtagattaagatcggccaacaagtagatacatattggaataatctatttaattgatcaatccatatatgaggtgctgctaaaccagctgtatatgcttctgtattttcaatcatccaagtttgtaacattggagagataactgtccccacaatattatcaccatgaataccacatacccaacataatgaggcaaagaaatatgcaaaacagaaaacaaagatgttatccgcaccggaaagaactggtaataaaatatttgtgattactgcaggaatgtcgaatcccataatagtacgaattgaccaacaaattaaagcaacaaataaatatggcacaatagatgaaaaactatctgaaattgccggtggtacactacttggtaatttgatcctaatgttatatttgtaacataaatgaataacatttacagatatcgccatcgcaataatagcagtaacaatccccgcactaccccaatatgtaatttctaatgcatttacaccttcagaagttgctgcgataccgttatagtttaataaaatgaacgcaaataacgctcctacagcaccagtagttttattaatacccttaatatcagcatattcagctcccattgccacacacatataaattgccatgatattcattgacaaactattaattaatgacaattggtcaatatatggtgttaaaaacggtaataatgctttttctgtaatatttccatcagctccaaataaacaaataaccaaaaagattgatccaaccattgtaacaccaattgacgaaaccattcctctttgtaaaccttgaataaatggaatttgaccaaatttgattaacggactggaaattttatccataggtcccataatcttatctacaaaagaatttttttcctttttagacatgatactctcctcctcttcaatcgaaaaaataagcgctttcttttttctaaaatcattatagattttaatgtctattttatcaatttttctaaacgagcttatatgtgccgttttattacatgtctatattcactcttatttatgaaaaaactgtaacacaccaattgctcatcttattggtaatattacagttttataatcatttatattttttaattttgtaataatctttttataacttttttctttaccaaacaacgtactagtttataaaacaaaccctttgacacttacctttgataacatcgcaatttctccgggaaataagtactgagaaaaaatagaagatgctcacaaaggtatttcttgatcaacttctttaaaacagactaaatggtttgctgaaagatacaaaaacgtagatgatagatgcagtatattagtaaaagcaaagatcaataaaaaatatatactagcatcttttgaggacaaagatgaagtagtaattgactacaaaagattttttgatttagaattcttaaaataaacagtataaaaaataattgttataatatttaggaaaataagtatccgtcccaaagttctcatttctcaatcatgtatagaaggacatgtagatgaataaagaaatacgcgatgttctttattcatcttaccagagaagtttatatacaaaaagcctgttaactgaagtgaactaaaaaacactttagttaacaggtttttattcttataaattaaagtttactgtaaaagatttatttgatacaactcctgaaggagttatgactcttccctttgcaataatgctatatgttttattagaattcttaaatgacccagtatgactactcatttcaaagaagtttttagtatttaccttagtaacagttacccctggtttatagcttgtatcaaatttactaccactatatttatattttaatatcattttattatttccgttataaaatgataaagttctacttcctgaagttgaacgaaaatatgtttcgatatttacattaatagtttcactatcaactgtaatattgactattaattcattttctagttcgtttaagtcataatttaataaatgtttaacataatcatcataagacttgaaagtatccgtaatttctgagttaataaactcttcctcagataaaatgtaataattggaattataaatttcattaatatggtcaatccgtcttattaataagtctaactcagtttcattatcaaaagcttttgtcggaactatattaattaacattatcattgatagtgttaaaaggaatgtaaacattatttttctcattttatttctctgtttcttcaataattttttttaaaaatttaatgtactccttaaattccttttgcccatattctgtcaaattgtaagttgtttttggtttattgttgacaaattctttttttacatctataaaaccagcagaaactagttttttagtatgtgttgctatattaccatcactacaattgcaaagctctcgtagctgattataagtcaaattagattttgataatcctgcaaccatttttagcctaatatttgattcaaaaattttaaaggtttctcttccttttatcatccgtatccctctttagaaaaataatagtaaataacataataatggctacaagtccatatgtatcaaaatcataaaatatattcataaaaacaccaaaagaattagaaatagctcttgaactataaatgtaagccttaagaataaaagatacaacaatataacatataaacaataaagttataatcattgttctcttgtttctaaagtaggaataaatataaaataattcaattaaaactataatataggacaaagaaatagtttgataaaaagatatcattgcatcagtgtttagatagtttgttaatatcgggataattatttctatggaaaacaaaatagggaaaataatccataatttcaaaaacctacgctcttttaccgatagttcttttaaacatattgttttccaaatatataaatttatgcatatattaaataatacttttcccccattatacaaattgtagaaatatttgtagttataaaaaccaaatttaaagtttaagatatcgattatatatataagtaacatcattgaagaataacatataagccatttacaaaacacactaattattccacgatatggtgaatactccgttgtaatatactctgtatctttaatagcctgatttattatttttaatttattaatatcgttatttttgctcattagtataacctcgattatatataaagatattataacttattttatataaatctacaatttaaagctaaactgcccccatataacagtttagctctttattttgtatcatatctatttactatttagatagttatatagtagatgatttaaaattatagtctttaggaaattaatacattataaggaacgatggctcccgactgttgtgctagatacatcgcatttactgcaataccttccattccattataatcaccacttgcataatcataataatctgagatattaactaatttactactagaagtcggtttgctatagttaaaactatgaagtgcataataacaatcctttgatgcagttcctccagtatttgtgaaaatgtcacttccatttgtcttagaaccatttgctattttaacaaatacactgtgagacttaactctactgccgttagttggactatatgtggagtttttgtttgtatttacagtagcatgtattagtaattcagaggctaatttataatttttattgctaaaataaccaattactgcagcaacagcggtattaggctgatttgctctagttgtattttgaatagaagccatgtactctttttttattttctctaaaccgcttattaaatctttaatcttattaatttcggtcagatttttattttgtgtctcaattacaagtatttcttgatactcattagtcaatttgtctaactctgcaataatatctatatgttctgattctatttgttgctctaataattcataagttttttcttcttgattaattgattgtgcataaacattagtttgcagcaggcacatacaagtaacaacactaatacatcggatgagcttaattttatttttcatattcttccttctttctataaatattacctaaaaatatatagattttgaatattctttcttataaattataatggttatgataaagattgaataatgtatagccttgtcttatttttgttaataattactaacaatttatcggaattatttttttcaatgtatttccaataataatcatttttgaaatctggatattgatttgtattaattttcaagttaactaagtattccttaaataatgcttcaaaatcagtatttttgttagaaaacaaattgtttggaagtttacttgttttttctaactcaaaaatttcataaatagttccgtctccctgaaatccgatttctgtttttttctcatatagtgatttcaagttagaagatagttcaatgttccaattattaatgtattttctcgcatttgaattatggacataataaaaatatgagattcccagaaatagaaataaaataataaatatagatatgataacctttttcatttcttctctcccctttctaatttaagtatatcaaaagtactttttattaacaagtactttgtaatattgagaattataaaggcaaataatttttatgaaaaagtaatgataaaaaattttttattgacgatttaacattaatattgatgaaaacaatttaacacaaaaatagacctatatattaaataaaaatttctcatttatacctcttttttaattaacaataccatttaactttaactggattattttcattatctattgctatcagttgcagtgattttaatacttttttaaactcttctttagcaagctgatcatatatttctttattttcacataagccagcttgatgatacactattgccgccacagcataaaaagtataacctagagcatttgttggtgaatcttttgttgcacatgcaattaaaattgctcgcacaattgccaaaggtacaattgtctcctcaacatctttgataagctccttagcttcttttaaaagcattctttgttctttttttgttttagtaccagctaaatattttctagtttcacaaataatatgttttaaccttgcatcatcaggatatttatcttgataaatacttaataaattttgttccacgtaattcaaactccaatttgctaatgtttcagcactttgactctcaattaaagccattaatacaaccaccgtaggatcatctatatcgcctaacattctttttaattttaccataaaattatctccttcttaaatctattgcttcgataacaatattatacccatatcaacttctccaagcgattaaattgttattaatcctacttctgtttagttacttataaaaagaaaaaatccttgaataatcaaggattttataaacaacacatttgataaaattaacgttttgagaattgtggagcacgacgagcttttttaagaccatattttttacgttctttaacgcgtgcatcacgagtaaggaatccagctgcttttaaagttggtctataatcagtaccagcttgtaataatgctcttgagataccatgacggatagctccagcttgtccagagtatccaccaccatatacgtttacactaacatcaaattgagaagttgtgttagtcaattctaatggttgattaacaatcattaataaaacgtctgatggtaagtattctttagctggtttatcgttaattacgatatttcctgtacctggtgttagggtaacacgagctacagaagattttctacgtccagttcctctatattgtacatttgccattgttctgtatttcccccttaccctttaatcttcaattcttctggtttttgtgctgcatgtggatgttcactacctgcatatacaaataatttcatcccttgttttctacctaatgtgttatgtggtaacataccttttaccgctgcttcaacccaaccagttggattttgttctttgaattggcgagcagttttaacttttaaaccacctaaccatccagagtgacgatagtaatttactgtatctaatttctttccagtcattactactttatcagcgtttacgatgattacataatcaccagtatccacatgtggtgtgtaagtaggtttatttttacctcttaacactgttgctacttctgatgccaaacgacctaaagttaagtcagttgcatcaactacgtaccattttctttcgattgtggctgcattagccatagttgtttgtctcattttactttctcctatatccttaccggggacttagagttcataagaacattctcattataaatacttctatatttaatgtcaatgatttttctacaaataaattaccttattatcatatatttttctatttttgacttttaaaaaaactctagaataaaaacaccattttaatcattatttttattcattaattactgttactatttaatatttaactcatttaaaaagacagtgccagaaataatcaatagcactatctttctattttaattatattttctttttttaaacaataccaaaccgcccgcagataataacaatgatgtcataattgcacctaaatatgtattatcaccagttttaacacttgtattaggtttattttctggttttacctcaggtttcacttcaggtgtaggagcatcaattttaactaatttatcaattgcttctgttaattgagcataagctgattcaattgcttctttgtcacctgatgttatcgcacttcttacttttgctaaagcagtacttaatatatctagtgactctttagtataaatatctgttttccctaaaaattcttcacctttagcaatcacttgatctaattctgcttctgttacatatttttcaagattagctatagctgtatttaaagctctaattgcttcttctacagcctctttattagcacttgtatcatttaatactttagtcgcttcttcgattactgtatttaatttttcaatagttgcagctttatatacatctatcttagctgcttcagctattgcttctgctagcctagcttttaaaccttctttatcaacgacaactgcattaactacaacttttactgtttttgaatattcaccattgacatattttacatcatattcatctgctgtacctgtaatttttgtttctggatcaacccaagaccatccttctggtaatgctacatttgctaatttatcaccaacgattccatttaatttaaaatcactagggaaagtacgttcagcaactgttaaagtcatcgttttacgagtgaatttataatcactttcacgttctggtctatttccatcatattctatatcatttggaatagcagtataatgaatgttatatttaccaactggtaattttgctaaactagctagatcatctttgcctgtacaaagtaaatcaacactagttaatccaccttcatttttaaacatatgttcattttcaattgaaaaatctacaaaactattacgattagatgtaacaccagctaatagatcaggtgttgctccttcttgcattgttacatcttttaacccactaatttctggtgcagcatcgtaatattcttttgctgcagctttttgttcttcattttgagcataatatacataatcaattgcaaattcagttcctgctaaattagtttctacatcaccaggccagtttccacccatagctaagtttaattgaatatattgtggacgattaaaacatttttttgcagattcaccccaagttggattagttaaatctagggtattataaatcactccatcgacgtaccattcaattttatctggtgaccaattgataccaaatacatgataatcatcattgaaatcagcaccgcttgggtttgtatatgcttttcccccagaaccagttgtatcttgatcccattgatcaccgatatttttatcataaaaatgtggtgtcccccatacttgtttatttcgagcttcaccttcataaccacctaataattccatgatatcgatttcaccgcaacgtgaccatccatatccttgtttaccattaatctttccatcaagtgtaaaatcagcacctaatgtccaaaacgcagggaatgctcctcttccttttggtaattttgctctcatttcaattcttccgtataaaaattcttgttttccatgagttctcacacttccagaattatagattacttgacgattaccacgaggatttttatattgatcttcttttgcacgatcagtagcctttaaaactaagtttccatcacgcataaatacattttcgtcactttttacatagtgttgctgttcaacaccgcgaatacttcctaattcatatccccagtcacttgtatctaattgcgattcattaaaatcatcagcccataaaatatcataatttgaatcttcttcgctgtctccaccgataagttctacatcatcaaaataaacagtagaatttttcagtgagtcacttgcattcccatctacccaacgtgcaacaccaacaacatatgctgtttctgatgatgttgtaaattctaattctacttcttcccatccgttggtaggactaattggcttatccttaaatgttttcggagcgtttaatcctcccgtcttaacatccaaggtaattgtatcatcagaattttcgcttgaaaacttaacttttgcttttaatgtatatttagtgtttggtttcaaggtcacttcttgccaaatatgtccattagcatgcaaatcagtagttgccccaagtttccctgatttaccaatagttacaccatcttcagcaacaacaccagaattttgccctgcaatattccagttagtagccccattatcaaaattaccgtttttcaaaactgaatcttttttcatctctactagatcatattgatgatctacagccgcatttactggtgaaattgtaggtactgctgccatactagttaacattcctgcaactgctacagatgataaaacttttctaaaactccatcttctctccataatgttctccttttctcgtatagaatagcgatttagattataacttaatgtatttattgtcccacttatccaatacaaaagacctgactaaaaacaacacgaaaacacggtataaaataccttacactaaaagtgtattaatcgtattcttttaatcaggtcttgcctaatctaatagtaacaatcctatcgcaatatcattatatattctttcatcactaaaagtcaatattattttagtaaataatcatagttaatttactttcattttagtaaattaactaacaaaaaaaagtagagcataactctacttactttgttaaaaaatccaacgataattttaaaacttctttaatatgttcaacagtatcataattatggtttgccccttcaattggtacaaattttaattgttgattaaacttgggaacatatattttactaatatcaaatggtacagttgtatcatttgtaccatgaattactaataattcatttttatatgtatctagatcagcataaaaatctctagccaaaatatcatctacaaatgtctgagagatttcataaccgccatgatcgtataatccattagaacttggctcaaccttaccagtaagataatctaaagctgctggtaaattaaaagcaggagcccataatactaatttgctaattacttgtggatataacttcgctaattcactagcaactgcaccgcccatagaatgtcctaaaacataaatttcagtacagttttccatttttaatgcttcctctagaataacacgtgcacaagccaactcatctttaaaagtcatatctttaaaattaagatcactttccccactacctaaaaaatcaaatctaaatgtagctattccttttgcttccagcatccttgctaattgaacataacaaaacttcgtccccgtcttttgaccggtaaagccgtgaaaaattatacatactggatgtctatctaaatccggcttatgaaaaaatcctctcatcgttccttttggagtaggaatttcacaataatgttgcattacaacacctcgtgcgcttttttaaagcgtttaattccaccattattaatgtattggtttgtaatattacgaatatttgcttcttcaaaatcaccaccaataaataaacatgtatccataatttcaccagttaaagcaagccagatttcatcactaaaatcttcttcagtaatcatctctttgacaatttttaaacaattatcaatgtaatcatccttattaatttctgtaattccttccattattcttcctccttcactaattcttttattacataccccgcaatcatcagaccagctacactaggaacaaaactcacactacctggtgtactgccgtcaacttcttgcggagattctgtcgaatataaaataggacatttttttatgccccgattctttagttcacgacgcattactcgtgctaatggacacacactagttttataaatatctgtgatttcaaaacggcttggatctaatttattacctgttcccattgatgaaatgactctaactccaaggtgctgacaattttcaattagtgccaatttagccttaacagtatcaattgcatcaaccacaaaatcacaatcttcaaaaatagtttccattccttgatctggtaaataaaactgttggtaggtagtgatctttagattaggattaatatctaaacatcgtgctctagcaacatctactttattcatcccaatcgttgaatgcaacgcatataactgacgattcaaattagttatatcaataatatcatgatcaaccaaaactaattcgccgatcccgtttctaacaagagcctcaactacatagctcccaactccccctaaaccaaaaactgcaacttttttattttgaagacactcgatccatgaagatcctaccatccttgtaattcttgcaaactgttccatattccacctcgtgcttattataaactaatctatctcttttataaagaataagcaaataattttttcttagtccaatttaggacatttatgcatagaccaataaggtccactctataataaatttaggtggtggttttatgtattacaaaagaattcgcgatttaagagaagataaagaccttactcaaaaacaattagcagaatatttaaatgtctctcaaaaatcttattctcgttacgaacgaggagaaagaaccatcgatccagagattttatccaaactcgcaacatttcatgaaaccactgttgattacttgatcgaacgtactgatgataaaactgattacactaagaaaaaacggcgctagttaactagcgttttattattttagaccgttttggtctaaaaacttctagtcctaattagactaatctataattgaaaaaggcggtgatatgatgcaatacaaacgattaaaagagcttcgaactaaatatggctacactcaagaaaaagtagccaaatatttacatgtcgatcaaaaaacatactcccgctatgaactaggtcaacacgaaatgacgcctgatacgcttggaaaacttgcaactctctatgatacctccgttgattatctaattgaaagaactgataatataaaaagttttactaaataaaaaacgtttgatgttccaaacgttttttattattcataatcagccgtgtaaccacgattatctaattccaatttcacaacttgccaatctttaattaatgcacctagctcttctttaatccgaactacacccatcttatcctcaccacgaataacagccattattgttggaccagcccccgacaaataagccccaagtactttttcatcttgttctaaaactcccatgatttcattaaagcctttaattaaatcaccacgatatggttgatgcaaacggtctttaaagcctaattttagcccctcatcatatccattaatcaatgaagcaaccatcaacgctaaatgagatacgtttttaatcgcgtcagctcttggcaaaacctgtggtaaaactgatcttgattgttcagttgataatgtaaatggcggaatcaatgtaacaaaccgatagtcatgtttaacagggatatttaatgttaatacattatcttcttccattactgatactgtcaagcctccaaaaattgccggtgccacattatcaggatgaccttcaattgcagttgctaattctagaatttcttgtcgatcttcaactttatctttaaaagcaaaagccccaacgattcctgctacaatacaagtagaactactacccaatccacgggtataaggaacatccccactacattcaatatttacgccttgatattctaagccacaaatttcagcagcttgtttaaaagcctggtaggtcatattttcttcattacaaaactgttctggacaaccagtaatatttaaaccttgatcagccagttcaaaggtaaaggtattatataaagtcagtgccaaccctgcaacgtcaaatccgggtcctaagttagcacttgtcgctggtacttttacttttactttcatgctaacctcctacattgcttctatttctgatttgataaaactaataatctcagttttatcaatcgcttctttatgtaacacttcacgctctttaattcctgctaatgcttgaggcacaggaacaccagtcttttcacttaatttatcaattgctgtataaacatcaagttcttccccataaatagcttgataaactgattcagggaacttataaggagatgcagttgataataatactgttttagtatggtctccagtctcctgctgatattgttttagaacaccataaccaatggcagtatgcgtatctaataaatatccagtttcattgaaacatgttttaattgtagttaagatttcatcttcacttaaacatcctgctttaaactgatctttaattttagcaaaagttgcatcatctacttcataaacaccttcactatttaatttatccatatattgacgaactttttctccatcaccatcagacataaaccaaaccaatctttctaagttactagatactaaaatatccatagctggagcatttgttttataaaactcacgatttgcatcatatttaccagtagtaaagaaatctgttaaaatattatttttatttgaagcacaaacaaatttatcaattggtaaacccatttttttagcaaaatatcctgctaaacagttaccaaaattaccactaggaacacagaaattaatcttatctcctaatttgatttcgttatttcttactaattcaaaataactatggaaatagtaaacgatttgaggaatcaaacgtccgacattgattgaatttgcagatgataagaaaacattatgttgatcacttgcaactttcaattcttcagatgcaaaagctttttttaccgcactttgagcatcatcaaaattaccgtgaattcctactaccttaacattctttcctgtttgactgaccatctgttgttgttgaatcgcagataccccatccaaaggatagaatactttgatacaagttccctcaacatctttaaaaccttctaatgccgctttaccggtatcgccactagtagctgctaagatcattacttcacgttcctcttttaattgttttaaagataacgtcattaaataaggtagtaacgataatgccatatccttgaatgctgccgtttgtccatggaatagttcagcaacataaacatcaccagccttttttactggtacaacgatttctggaaataatccttttccatacgcatttaaacacgcatcatgaatcaattcttttccttcttcaggtacaaatgtacttaatacttcagttgctaaatcaacataattcaatttagataaaacatctaaatccatctttgtaaaatcaaaatccggcactaataacccaccgtcttccccaattccttggacgatagcctgataaaaattaatctctttttgttggtttcgtgtacttatatatttcttttccattgttcatccccctgtgtgatttaaactattgtatacaatttatttatataagtcaatacatacttattataacatatcaaagtaaaataactttgattatttcaattattattgattaccattgactattgtatacaatcgtggtaatatgtcataaattaggaaattggaggaccgagatatgttatcaatgaacatgtttgcaataattatggcaacgattagttccattattgtgcatgctcaataatatattggttctgctatttatttaatgatattgggaccttattttaaaggtctatttttattatataagggggaattagatgaaaatcggtgttatcggactaggtactgttggttatggagttatcgaaatcctaactaatgaaagaaaacgtctcgaaaaagtcattaatgatgaagtaatgattaaatatggttgtggtcttgaagaggttgatctaccagagggggtaatttacacaaaagactttaatgatgttataaatgatcatgaaattgatgttgtagttgaattgattggtggagtaactgtcgctaaaacaattattttagaagctataagaaatggtaaacatgttgttactgccaataaagcattattagcccatgatggtaaagaaatctttatggcagcaaaagaaaaaaatgtccacattttctacgaagctagtgttggtggcggaatccctgttttagtcagccaaaaagaaagtttagtcgctaacaacacaaaagaaatcattggtatattaaatggaacaacaaactttattttaactttaatggaaaatgaaaatttagattttgatgaagctttgaccattgccgatggcctaggttatgttgaagcaaatccagcattggatttagatggaatcgatgctgcccataaaatttgtattttagctcaaaatggatttaaaaaatatattgattttgataaaattagtgctagtggaatccgtaatgtaactaaagttgatatggattatgctaaaaaactgggatatcgttttaagatgattgctcaggcaaaagaagttaataacggaattggaattgatgtcgcagctactctagttagtaaaaaagaactagtagcaaacgtcatggatgcatataatgtagtagagatcgataatgactatgttgaaaatgttatttactacggtaaaggtgcaggtcgttatgttaccgcttctgcagttgtaagtgatataattaaaactacccaagtagaaagatgggatcatgattatgaagactgctcaaacatctacccgattactaaatctaagtattatcttagagcaaataagccattagatgttgattatgaaatgtacttcactgaaaaacacgatcacatctacattactcatgaaattgagttagcagatctaactacagatcttggtgatacagaatacacaattttcaaagtgaggggataaaatgaacataattgtccaaaaatttggtggtacttccactcgttcgcgtgaatcacgttcaaccatgtacaacaatattattagagaaatcaataatggtaataaagttgttgcggttgtttcggcgatgggtcgttatgatgatccatatgctactgatacactattatcaattgttaatacccagcagttaacagatgaggagattgatcgtctaactagtattggtgaaacaatttcaactttagtttgtaaaggagaagttgcttctctcggttatcgagcggcaacaatcactaattcagaattaggaattgttacagattcaacttttaataacgcaacgatcaataaggttgaaggtaaagatattattgaaaaattaaaatacgctgatgtcgtattttgccctggttttcaagggcattctatccatggtaaaattaccactttaggtcgcggggggagcgatttatcagcagttgcaattggggtagcaattgatgctagtgaagtagagatatacagtgatgtaaatggaatctacactgctgatccaagattagttcctgatgctcttaaattggattgtatcagttatgcagaaatgctggaactagctaaaaatggtgctaaagttttaaatcaccgttgtgttcaattagcagctagtcacaatattgcaattcacgcccgttcttcatttgaagacactaaagggacatatgttataggagatgagcgcattatgaaagaaaatttaaatcaattaattatttccggaatcaccggttcacaaaatgaagcgcggatcactttagttaaagtagatgccaccaacaatagtgcgggaagcttatttgaaaaaattgctgatgctggcgttaatgtaaatgtatttaatcaagcattagttggaggcggaagaatggatatttcactagttattagtgatgttgatgttcctactgtcgttgatattatcaatgatttaaaaccacagttaaatgctgatcgtatcattgtccgtggtaacattggtaaagtatcggttattggggttggaattaaaaataatcgtggaatgttccaaaaagcatataatacattaagcagcaatggtattaatgttgaaatgacatcttgctcagaaataaatatttcttgttacatcgatcgtgacgatgttaaaaaagcacaaattttattacatgaagcgtttttaggaaaggttggtaaataaaaaatgaaaaaatataaagttgcagtcgtgggggctactggagccgtcggaagagaaatgttaagatgtatcttccaatttaaatttccttttgaaagtattaaattattagcatcagctcgtagtgcaggaaaagttgttgaatttgaaggtcatgaatttactgttgaagaattaacagaaaatagctttgaaggtatcgatgtagcgttttggtctgccgggggaagtatttctgaaaaatatatgccattcgctgttaaagctgggtgtgtcaatattgataatactagtcatttcagaatggatcctgaggtgccattagtagtacctgaagtaaacggagaagctttaagaaatcataaaggaattattgctaatccaaactgcactactatccaaatggttagtgctttaaatcgtttaaatgaatattttgatatcgaaagaatcatcgtttctacttatcaagcggtttcaggagcaggtgttgcaggaatggaagaattataccgccagtctcaagaaatcttagatggtaaagaacctgttgccaaaacattaccttgcgctggggataaaaaacattttccaattgctttcaattgcattccacaagttgataaatttgatttagacaatcatttttctaaagaagaaatgaaaatggttaatgaaactaaaaaaatcttcaataaagatatcaaggtcaatgctacttgtgttcgtgttcctgtacttcggggacattctgaatcagtatatattgaaactaaaaaaccaatcgatattgataaagtattcgagctactaaataattctactggggttgaattatatgatgatattgaaaatcaaatctatccaatggctaatttatttgttggagatgagttagtacacgttggacgtgttcgtaaagatttagataaccctaacggattaagtttatgggtagttgccgatcaattaatgaaaggtgctgcttacaactctgttgatattggacttaaaatgattgaaatgggcttaatttaataaaaaaggaattttattcgatggtgatatgccccttgttaagtagataaggtaaataaccaaaatctacttaaggaggagcgtaccatagcttgaataaagttcctttttatttatttatattttccaatacaaataatgcttcaaattcttttagcagcatcggccgataataataatacccttgaatataatcacaatcatgagcttcaagaaactctttttgttcaatcgtttccactccctcggctacaacttcaaggtttaacttatgacataattggattatctcttcaataataatatgactgcgagtatgtgtatagtcatttgttctaaaaaactcctgatcaatcttcactacatcaataggaagatcttttaagatattcaaggatgaatatccgcttccaaaatcatctaatgctactttaaaatgataactttttaattgatttaaaatcttaattaactcttctttatgattaagtgctgttgtttctgtgatttcaatctctacttgttcgggattaacattacacgctttaaccagatgaatcaatttatccacatatccctcattaaaaatataagttcttgaaacattgacagagatacttatcttaataccataatacttgttccaataatcgatctgttccaaagcttttttaaaaatatggaaatcaagagcttccaacattccgtttttttcataaaccgggataaaatcaccaggtgaaataatattgtactcaggatgatgccaacgtgttaaaatttcgcctgagcaaaccttccctgtttgaagatttactttcggttgaatgtaagctttaaaatgattagcttttaacgaatcttgaaactctttttcaatttgcaatgcataaagctctttttgaaaaacttcttcttgataaaagctcacatcatcttttgataaacgttttaaatcattactagtatattgagtcttcttgaaagccaaattaatgtcaacatcatcctcaagaattttataaacaccaaaatggaaataatatggtgaggtattatattctttcgcaaattcacctctaatataattggctaacacaaataaacgattcttgatttgttcaaagtcatcactatccaataaaattacaaaatgatcggcagattggcgacagcaaaattcttcattttgacattgagtatctatgcaaataataatttgttttaataatctattagcaatctcttctccatatatttcattaaaccatttaaatcctttaacatcacaatttactaaaacatatttagataaatgattgatattttgacaatattcaataaaccgatagtaattataatgaccagtaatctcatcttcataagctaatttagtaatttgcagcttatttttcccttgaataaaataaaaataagcaactacgactgcactgccaaccccaattataagccaggtaagataagcagtttgaataaaattttgaaacttcccagttacagcttctttgggaaaaacagaagcaactagccaatcattaccttcaatattagcataaatcaaataattaagagtattattttcatcacgaaagtttattatgcccttcccatttatatcgatatcattaagatcaatgccattcaacgattcaatattattaaaatcatctgtcttcttattacttaaaacaacatcaccattttcattaaaaataaatgcatagccaacattattataagttgcagacgacaaaatacttgataacttatctgtataaaaagtagcaaacaaaaccccactaacttcattatgtttatatattagtacagaataaacattgattgcctcaccatccgtataatcagtaatacttttcgaggttacagttttaccatttaatgaatctttaaaataatctcgatcagaaatattaaaagtctgatgatcagaggttattacatttccttgtaaatctgctataccaaaacgctttaccccatccctttgtgccaactggtttagataatcaagtaatggctcttgaagaattccatcttgttgaataattaaacttatcgtcgttaattgggtcaaattttcattgatccggttttttattgctttagctgtctgattggttaaatcattcaaatactcgtcagtttcactatacagattatctgacaagttattaatatacaaagttgctaaagttccaaagagaattaatagtattattgcaacaataattgatttcttcattattgaacttctcattatcttcaccactctttcttctattatagctaattctataaagaaaagcattaaaataaaaaggccatagcctaaataagttaaataaactcatttgactataaccatattattctttgggagcaatttttaaatcttccttattaataatttcaccacattctttacaacgataaacaatctcgatttcaccttgacatccatcatggctaatacatttataacttttatctaaatggcgatcaccccagataatcaaagcattataaatatcatcaagatcaatacttttagctgttaaactatatcgataacggggaggatgttttgaatatagttcacattgtaataaatcatcttgacagagctccttaagtcgatttgataataaatttgtagggatacctggtaatgactcatgaatctctttataagtatgttttttttcttttaccgcatgaagaatcaataatgtccatttatcaccaattatatttaatgtttgagcgatattacaacaaagatcatattgctttttcattttattcacctcagttcaatcatatcttacttgccttttaacgttcggtcaataatattttccatcatatcactcgataattgtccaactacagagccgtatacattcccatcacgatcaagcatatatgttgttggtaagcttgtaatctgaaagctactgcttaaacgaccatcatcaaatataactggcatagtaaagcctttttcttttaaaaactttttaattccagcagcatccatttcctgacctcctggcattacaactgttagaatagctatatcttcactattttgatatttttctgaaagtttttgaatttccggcatttctctttggcagggagggcaccaagttgcccaaaaattcaaaaatactacctttccatgataatcagctaagctaatcggtttatcatcttgattcaataaagcattgccataattaaccgaatcatcactattttcagcttggttagtggatacttgcccttgtgaaggtgacatataattgctaattgtattaagtttgccactaaacatcatcaaaccaaagataatcaaaataacagcgcctattttagttgtatatttaactatatcacgatggctatttaaccagtttaaagctttatttgtaaacaatcctaaaactagaaatggtaaagtaaaaccaaaagcataaataatcattagaaaattactataccaaaaatcacctgaactagctgctaaaagtaagattgatgacagcgctggcccaatacaaggagtccaagcaaaactaaatgtaaatcccatgataaacgccaccatcacattcattttattatctgttttcaaagaaaaacggaaagttcgttgtaaaaaatttattttgataaatcctaactgataaattcctaataaaacgataagaataccgccgattcgaacaaataaagtcatgtgttcttttaaaaaactttgtaataaatttattgacgcattcatcagaaaaattgctaaaagtatcccaaagataaagctgattgtaaataataatacttttttatttgagtttcttttttcgttactattaccagctaaatagcccatataaataggaattattggtaaaacacagggtgaaagaaacgatactaacccttcaacaaaaactaatgcaagacttatatgtgttgccattttaacttgtaatcattgctaagatttcaggatatggaataaatccaattttttgatttacaatctgtccttttttaaaggctattagtgtcgggattgtttgaaccccatataccgcagcaatttctggatgtttatcaacatcaatctttatcactgtagcatcagcattttcttccgctagtttttcaatattaggaccaatcatcttacatggtccacaccatgttgcaaaaaaatctactaatactttttcatttttgattaattcatcaaattcttgtttatttggatataatacattactcatttttattttctccttttttctattttataaatcaaacaaatcatttaacgcttcagccattgttggatgtgtaaagatttggttctttaggaccttgtaagataaatcattattcatcactaaagttactaaattaattaattcttctgaatgttcacataacaatacacaacctaagattcgctcagtttttttatcaatgatcgctttcaacaatccttctggcttttttagaacattagctttaggtactgcagctgttaataacttagtcacaatcacttcataaccggcagctttagcttctacttcacttaaaccaattcttgaaaaagttggtgaaataaataccgaataagcaatattaccacgatttaaagtagaacgctttttatcaccaaatagataatccataacaattcttgaatcatctaaagaaatataagtaaactgaagaccaccttttacatcaccaagagcaaaaatatttttctttgttgtttgcagatacttattgactacaatttcacctcgttggttaacctcaatacctgcagcatcaagatttaaatcagctgtatttgccttacgaccagtagccatcaatatcccggcgaagcgttgtgaaacttggtcattataagtaactagaacttcttcgccttcattagcaagagcttgaatattagcattaaaaacaaacttaacaccttgtttttctaaaattctttgaatttcttcagcaatatcccgatcctcacgagcaatcaaacgatcattactttcatatactgttacctcgctaccataacgtgcatacatactagcaaattctaaaccaatatatccaccgccaatgattgctaaggtttttggcagttcttctaatttcatcaaactagcacttgtgtatactttgttagcagttgctagccccttaattggaggcataactggagtagctccagtattaacaaagatcaggtcaccaaaaattatttcttcttcattttcggtacagatagctacatggtggtcatccacaaatttggcagttgctgtaattacatcaacattttgtaaatcagctaattttgcataattcttattacgtaatttagtaattaaatcctctttattaattatcgcatcatgataattatatttttctgcttgagtgattaatgattttgaaggaatacacccttcattgatacatgtcccaccatacatttgagcggatttttcaattattgcaaccctttttcctaattttgccatcttaccagcaattgttttaccaccttttccaaaaccaattattattgcatcatactgtttcattttcagttcctccgttccttacatttacactttaacatagtaactttactttttcaagtaatttgatttaagaaagttataattaataaaaaaactggatttttccagctttattgccatataaagttgttcgttccagctccaatttcaaaatgatatttaacaattcctaaatctagctttgtataaaaacccagacccggctttactttgacagtattatcattaaggataaacttaaacttttgttgattcatcgctgttggcgctaataaagcagttttaacacctgtttcaaaccaactaggcatatctccagtaacttcactaacttgctcaatcgtcttaattttatgtgtagctccattatcaataccataaccaagtgtaatcaagcaacataaacgctcatcatcgtcaatcacaaaggcacttttaactttcttgtatgtcaaagccacccaacaactgttcaatccaagctgctgagcttttaaaacgattttctcaccataataaccgcacatttcctcaagtttcacactcttttttccaattaatgccaaataatttttgaccccactgaatttaccataatgagccataaagttatcaaaggcttttggttcatccaaaatcaattgaatatttaaaccacttgtctgattacattgattaataaaatccaataattctttttttatagaatctggaatttctctatcttgatacattctgactgaatgccgtttttgaactgcttctaaaagttccattactcttcctccatttcacaccttgatacattattcataatctctttaatatgctgaaataaattaatcagtttatcaatttcacaatgctgcggttctaaataataataaatacaagtcttaactttccgcgtcttaacaattcctgcctgctttaatatttgtaaatgatgagataccgccggtctagaaagatttactttgggagccaaatcaattacccgactaccatcacatggaccttcaagcataatcaataataaatacattcttgtctcatcaccaagtgcattaaaaactttttgactcgctaaaaattgttttctcaaagattcgctatcttgaattgtatttttcatcgattcatcctccctgttcaaatatttaaacacttgtattatagcataataactgttacttattttatcggtaaagaaaatcaagatagagatattatctttaagttttctttagaatcactttttaacttttgctagttatgttttagattcgttgtctatactaataacgaggtgaaaaagatggataaactaaatgagcataaaaaaaacctttcgcttttaataaccggtttcataattattacaattctgtgtctagttctttatcatttttttgaaaactttttaaatgatcctattgaattgaaagaaaagttaactgaatttggtagttggggaaaattaattcttgttgctgctatggcaatccaagttatttttgtttttttaccaggtgaaataatcgagattgctgccggatttagttatggaactattgaagggatggcaatttgtttacttggtgctattattggtactatcgttatctatgctattgttaatagatatggcatcaagttagttaatcatttttatgatactaacaaatttaatgaaatttcatttttaaaaaaagaaaaaaatcttgaaattatcctctttgtcatcttctttattcccggcactcctaaagacattttaacataccttgcaccttttacgcgtttaaaactttcaagttttatattcattactagtatcgctagaatcccatctgtaattacaagtacaatagggggcaacgctatctcaaatcaaaattatcgttttacaatatttatttttgtaattactggaattatttccatttttggccttcttagctataagcgttacatcaagaaaaaaaatctttagaaaatcttttgaaatcatttctactattctttaatgattggccttataattaatattatgaaagagggtatgaggatgaatcaagataatatattagtggtagaagacgaaattgaaattgccaaagccattgaaatatacttaaaatcacaaggttataatgtatatattgctaataacgggaaagctggtttagagatggtggaaagatatgatatccatcttgctatcgtagatattatgatgccagtaatggatggaattgaaatgacaatgaaaataagggaaaattatgatttcccaattattttcttatccgctaaatctgaagatattgataaaattacaggattaaatattggtggtgatgattatgtcaccaaaccatttgttccaatggaactcctagcgcgtgtttcttcacaattacgacgctatcataaatatttaaatatgatcggtaagattcaagaagatcaagcagcaaataaatatgttgtgggtggtctagaacttgatcttgataccaaagaagttagtgttgacggtaaagctgttaaagtcactccaattgaattaaaaattctcgaattactaatggaaaagcccgggagagttttttcaagcgaacaaatttatgaaaatgtttggcatgaagctgcaatcaacacagaaacagtcatggttcatgtgcgaaatttgcgagaaaaaatcgaaattaaccctagtaatccccaatatttaaaagttgtctggggtgtcggttataaaattgaaaaacagtaggtgataaaatgaacagaaaaaaaataattttttcaattttaacaattgtaattattctccttagcagtgttggtatatatagctgctatgaggttgtagaaaccagtaacgggaaaagtattaacttttcaagtaatcaaattctttatgatatttttgacaatatctatgctctgagcttccagcttgacaatgtcagcaaaaaagaaggtattccaaaatatcttactgccaacgaagaagctagtgatgaattttatcggaataatattttatattgtcgtgaaatgatgtctgaaaagaaaaatattaaatactatgcagaaggcaataataatagcttaggtaatactaatgacgatataaaaaacattcgtaacaataaagaattgaaagaaaaatatcaatggtatttaatgattcactttgatgaaaatggtcaatttagctatgatactttaggctgtttagtagctggcaatcaaaactatgaactagtttggaataattataaacaaacatattttcaatatctccaagagtatgatgaagatagtacattgcataatccagtaaatacaactatctactttgccgttccccataaaatcgtaagcaattcaattgatacgattgcctggtatagcgaaaaaaacaatcgaactataaatgttgaaaatattgtgccatttgctgcaattgctgtagctgctgttggcttatttatcttattagctccatatgaaacaattaaagaaatcaacatctttaaatatcccgctaaaatcaaattagaaccattagtaattgggattacattggcatttgcaggaataatcgttgtaatttatggtttaattctcgataccataaacggctattacattactaaattgtcagggattggttttggtgaatcaagtgaactgatccttggagcgatgaatgtactatcatgggcagcttttttattcctatgtatgttctctgtcttttatttaaaatcattctttaaagaagggattattaattctattaaaaaaaatactgtttgtatttggttacttaatgtattaagaaagataatttataaagccagtagatttgacttaaatgatgatacaaacaaaacaattcttaaaatcgttttagcaaactgcttaattatatcaataatctgttgtttctttacctttggtattttctttgccttagtatattctgccattttatttattattttaagaaaacgatttgatgaacttaaacatgattatgaaattctattggatgctgttaaacgtttatcaaacggtgattttgatgttgaaatcaatcaagatattggtatgtttaattctttaggtactgaattttctaatattaaagatggctttgaaaaagctgttagcgaggaagtaaaatcacaaaaaatgaaaactgaattaatctctaatgtctctcacgacttaaaaacaccattaacctccatcattacttatattgatttgttaaaagacgaacaacttgattatgaaaaaagaaaagaatatctcaatacactagatcgtaattcacttagattaaaaaacttaattgatgatctttttgaagttagtaaagtcaatagtggtgatgtaaaactcaaccttgttgatgtcgatattattgcattgatccagcaagctaagtttgaattaatagataaatttaacgaaaaaagcctaatttttaaaactgcttttccaaatgaaaaaattattttatcattagatagtttaaaaacatatcgtatttttgaaaatctcttaatgaatattggaaaatacgctttagaaaatacacgtgtttatatcgatattgacaatagtgatgatgaagttacaatcacttttaaaaatatatcagcagatgaaataaaagttagcgaagatgaattagttgagcgttttgttcaaggtgatacttcaagaaatactagtggtagtggcctcggtttagctattgctaaaagtttcactgaactgcaaaaaggtaattttaaaattagtgttgatggtgatttattcaaagcatcggtaacttttaaaaaataatttcatacaaaaagacttgtatcctaacaaataaggtctacaagtctttttatcataattgaattttcattttacttttgtaatttttcaagtagaccaacacctagtggatgtggtcctgtatgaacaccgatcgttgctccaatttgccgaattggtacctcagcactaaatgatggatcaaaccctttcaaagcagcaaggaatgttgttttaaactctacagcctcatcataatcataaccaaatcctatacaaaaacgatatttactcaattccaaattatcttccttaaaataattaataatttgttcaactatcttttgtttagatttttttcgtccgcgtgttaatccgttattaaatatttctccttctttaagcaaaatcaaaggtttaattcccaaagctccagccgcaattcctgataattttccaactcttccaccatgaactaaataatccataccaccaatagtaaagaagatccttccagtgattttaattttgttaatatatgcaaccgtctcctcaaaggttgcacccgtctgcttgtatgcaaccgcttcttctactaacattccttgtaataccgtattaacggtagcatcgataacttcaattttcacatcaggaaattcatcagtaagcatatttttagcattcattgctgaattatatgatcccgaaaattttgttgtaatacaaatacaaataatatcaataccatctttagccaaaggtccaaaaacatctaaataatcttgaatcgacggcattgacgttttaggaaatactttggggttatcaatcataaattgatagaaatcacggatacccaattcaacaatttccttttgatgattaatcccatctgttgatacataaaaaggtactactgacacatcaagctcttgtgcacgttcagttgacagatcgcaagatccatctgttataatcttatacattctttttcctcttctctataatactataattataacccctaattattaacttttaataaactactttactttttcttttattgatcagcgataaactccgttctatttcagcttggacaactggattttgaaaatccagctgttttaaaaaagcctcactttgattaaacgccgataaacaaatgatcaatttccatttcatcaattcattatcatgataacgttcaaatgattgaataactgtttgataatttttagcagttgccaattcttgatgataaaaaaccatccagccaattgcatcaattgcttctgcaaccactttatcttcaggataattaatgatttctaaaatcgtagaaaaataatcaggattcattttagccatagttctagcaataatatcccgtggcaaaggatagctttttttctttgataccttttcaggaatcgtccgatgttgattacctctaattgtccccatataaggaatcattctttttattgtcaactcatttccggtagtcaaaatatcgcatatttctaatttagtatataaggctttttctttaaccaacattctaagtaagatttcatcaagttcattaatgtcaacaaagcttctaagaataaataacgccgcagtacgatttacggctgttttatcttttaatagttctaataactcctcttttgaatataaaaagtagggttcggcttctgtatttgttaaaaagccacgttttctaagtgtttcagtatctgttttcatagtcttattataccaaaaattaattcgcttaaaaagtttattactacttcaatctacaaataaaaagccacagttatcaaactgtgactaaataacttcttcttccattggtaaagttactttaaatgttgttccttcatgtaatttacttgttaatgtaatatttccttgataatattgaacgatatgtttgacaatcgctaatcctagaccagttccccctgtttctttatcacgaccttgatcacacctaaagaaacgttcaaatactcgtccctgatcaatttttgaaattcctcgtccagtatcactaacttcaatgataatattacgaccaaattggtatgacttaattataattttaccaccatcaacattatacttaattgcattagtaatcaaattacttaataactgatgcatatgctgatgatttgatgtatatgtaatatcttctaattctttatctacttgtaaatgtttcttatcaatctctacttgcatcgtatcaattatctcatctactagtggtgttaaatgaactggatgcttgattacatcaacatctttattttctaatctcgatatcattaaaatatcattaattaaagtagacatattattcacttcatcatgaattttatccaatgctttttttgaagcatctttatcattgataactcccgtttctaataattcactatatccacgaatcgaagtcattggtgttttcaactcatgagaaacattagagaaaaattcctgacgcatcttcatagcattatgctgctcagtaatatttacaaacagcaaagttaccccataatcaaccttagcgacataacagttatagaattctttttccttttcaacttcaactacctgttgttcatcacttaaatggtcaagtgcattaataattttaaagtcaaaaataaagtctttgattgaacaatttaacttgattgtatgaccatataatttttgagctttacgattaaccattaaaactgttaaatcactatctaataagacaaagccctctttcatttgatcaagaatcccattgatttttatttgttcacttttaagctttttcatagtatcatgaattgttttagcctgttcttccaattttgaagcaatgatattaaactcatcatatttataactatcaaattctagttcacgataatccttcatttttgtaacctgtgtcgtaatatcctgaattggtgctgtcaatgtattagcaaatcgtttcgataagaataaagcaatgactaacgacattatcgcgcctacccctagcggtctaaccaaagttggaagattatcaaaaataccattatatggtaaagccagacgaactatatatcctttattaaatactgccacatagagcatatttcttttaacagtacttgagtaacgggttgcataaccaaccccttcacttagagcctgtttaacttcttcacgacctttatgattttcatcaatttcttcactaccactatctgctaatacttcaccattagtatcaatgacagttaatctagtttgatcattgtaggcaagtggattcaatgcatctacttgtgcttttaaatcgtgtgattcatctaattgataatcaaccaacttaaccgcgtaaagcatatcatgtttagtattttccaacatttgacttgataaaataaccattgaaacactgcttgataaaactagagtgactaataaaactgtgagaaaatagcgaaaaatagttttattcactaccatcaccttcctcataaaaacgatatccaacactacgtatcgtcttaatatacttatggccatcatcatttaatttacttcgtaaagcacgaatatgaacatctaaagcacgagattcaccaataaaatcatatccccaaatttcgtttaataattcttcacgttcaactacacgatgtttattatccattaaatagaccaataattgatactctttattagttaattctaatttctgatcatctaattttactaaacgtgtttgcttgtcaacagtaagatgtttagttctaataatatcgctagtaacatggcgtcttaataatgagcgaacgcgagcttgcaattcaagaatcccaaacggtttagtcatatagtcatcagaaccgctatctaaaccattaaccttatctatctcacgatctttagcacttaaaattaagataggtaattcactatcagtttcacgaatttccttgattgcatcaattccgctcatttttggtaacattaaatcaaaaatagctaatgatggtgcttttttatcaatttctgccagtgcatcgatagcattatcaaattgaacaacttcataaccattgcttactaatgctaaattaattatctcgcggatattttcatcatcttcaactacaaatatacgttcacccatgttcagtcccccttagatcaaacgataattatcaactgttccagtttggttaaattcaacccattcacaaatatttacagcatgatcaccaattctttcgaaatatttagcaatcattaggaagttaatcgctaaatcgattgtttcctttgactcatttactatttgtattaattctaccttaacttcttcaaatagtccatccatatcatcttccaatttttttacttctgaagctttttttaaatcatgctgatgaaaagcttcaattgattgtttaaccatatttttagcaagatgagccatattaggtatatgttcaaccattttataagggcaggttacatctgtatctaataaaatttctgcaatatctgctccttggtcaccaattctttctaaatctgtaacgacttttaaagctgtagacacatttcttaaatcactagctacaggctgttgttttaaaattaacgatagacaacgagcttctatcgttctttccatatcattaatcactttgtctccagctaaaatatcacggcataattcacgatctcctgatttaaatgccacaatacagttttcaattgctaaaataactagatgacacatcttatcaagatctacgtgtaatttgtttaaatcattttcaaaatttgttcttaacatttttttctcctatccaaatcttccggtaatataatcttcagtacgtttatctttaggcattgcaaaaacatccttagtttttccatattcaaccatctcacctactaagaaaaacgcagtataatcagcgatacgactcgcttgctgcatattatgtgtaacaattgcaatcgtatacttttctttaagttccattaacaattcttcaatttttaatgttgaaattggatccaatgcacttgttggttcatctaataagatcacatcaggttctactgctaaagcacgagcaatgcacaaacgttgctgttgtcctccagataatcctaaagcactgctgtgcaaacgatcttttacctcttcatataaagcagctgcttctaatgaatctttaacaatcttatctaactgttttttatttttgattccatgaattcttggtccatatgcgatattatcataaatactcatcggaaacggatttggctgttggaaaaccattccaacttttttcctcaaaaccgttgtatcaacacgactatcataaatatcttcaccatcaagaaccacactaccagttatcttaatatctttaacataatcattcatgcgatttaatgtctttaaaaatgttgatttaccacaaccggaaggcccgataaaagccgtaattttatttgttttaatatctagactaacattttttaaagcatgcttttcaccataatacagatctagattttttgcttcaattttattttccattctaatccaccctatttacatcaaatttatttgtaatcagttttgctaacatatttaatcctaaaacaataacaattaaaactaaggcaatcacaaaggccgattcataattagctttagccatctccaaatataattgaatcgttagtgttgcacctgaacttgataaatgtgtaaagatattttttggcaaaacacttactgaaccagctgtaaacaataacgccgctgattctgcaacaattctacccattcctaagatcacacccgttaaaattcctggcatagcacttggcaataacacagttctaatcatataccatttagtagctccaatacccaatgcagcttcacgataactttttggtaccccttctaaagctacctgagtatttcttgtaataattggtaagatcataattgcaagtgtgaaagaacccgttaatattgagaatttaaatcctaataaatttccaaaaaataacatcccaaataaaccatatataatcgaaggaattcccgctaatacttcagttgtaaaagaaataatattaacaaatttcttattttttgcatactcatttaaatagattgctcccccaattccgattgggcaggcaattaataaagtaattacaataatatataatgtgttaataatatttggtagtatccctaccgtaccttttaaaatactagtagtattaattaaatatgaaaaattaaagtatggtaatccacgatataaaatatatccaatacatacaaccaagatcagcactgacaaggcactagaaagctgtatcaaaaaatttaatattttatcgctgctgcgatgtcttctttcaaagatactattcatgctgatctcctctcttaataataaatgttaggatcaagttaataattatgatgaaaacaaatagtactaatccaatcgtaaataaaacttgacggtgtgtccctgaggcatatcccatttcagaaacaattcccgtagttaaaaaacgaactgaattgaatggtaaaggcagattaactgagtttcctgctactaataaaattgccattgcttccccaattgcacgccctactcctaatacaattgctgaaactatccctgatttagcactaggcaaaacaactttaaaaattgtttgcatttgacttgcccctaaagccaatgaacttttacgataatcatctggaactgcctttaaagctgtttcagtaatattgatcaaagttggtaaaatcataatcgcaagaactaaaattgctgaaatcagatttgccccaccagtaaactgatgagtctttgatcctgcaaaaattaataattctaacctatacataaacggacaaataattaaaattcctagtaatccatataccactgaaggaattccggcaagtaattcgattgcagatttaacaattttacgcactttcggatttgccaattcagctaaattgatagctgtaaacaatccgattggtaccccaatacaaatagctaaaaaaacaccaataattgaggtaagtataattaaaaggattccaaattgaggatcagcagcggttggcgcccaaacagttccaaaaagaatatctagtattcccactttgaaaatagctggtgtaccagaaataatcatataacctgtaatagagacaacagcaatgatagacataacagcacagccacgaaaaattatcgcggctgttttctctaccaaagattttgtttttctattacttataatagataacatatctttttccataattaactcctattttttatctggaattattaaaccaacttgttcaataactttttgtccagcttcactattgataaaatcgaacacagcttgtacttctttactttgttcactgatttttcctttagtagccattacgaatggtctttgtaaagtgtagcttccatctttaatagttttttcagaagcttttacaccatctaattttaatgatttaactgtgtcatcaacaacatctaaagaaacataaccaattgctcctgctgtttcactaacttttgccattactgcaccagtttcgtttaattcttgagcatatttacaagcatcttcaattcctaaaatttcttcaaatgctccacgagttcctgaaccagcttcacgtccaacaacaacgattgcttgatcatcaccacctaaatctttccagtttgtaatttcaccagtatagattttctttaagtcatcagtagttaaatcagacactttgttatctttatgagtaactacagcaataccatcaatagcaacaatattttcttcaattccttttgctttttcttcatcttttaaagctcttgaagaatctccgatatcagcagttccatttgtaacagcttcaatccctgcacctgaaccagtaaattgtggttctaatgttaagtttggatattcttcagtaatcgcttcttttaaagcatttacgaatttttccatagatgtagacccgttaaggctaacatttccgcttacatcgtttccacttgcagaagaatcatcaccagatcccccacatccagtaagccctaagcataatactaatgttaataaaactccgaatacttttttcatatttaataatccctttctttatcttttcttaagacacctatataataatcaaattgcaatttacgatatatcaataaattgtatttattatgttaagtttacgtaaagaaaaaagagaaccctcaagttctctattcatatatccttaacatagcccttattcgtgtctttacaatctcttttagacttaaaggaaaaacaacttcaaccttatcttgaagcatcattatccagccaattaaaccatctgataaagccacatctttaataaatgcttcaattcgaccatcaaagcatttatttacattaatatcttgtccaaactgattaacaacttctcttagtacactagattcaaaagcaatctttaaatcgattcgttcattactaacatacatattaacattattttcaaattctttttccatatcgaaacgatcttgaatatcttcataactactgctatgatttctcacgatacgcattcgatcaattcgataaacacttaaactatcttttcttttatcaaaataaccaatcaaataataattagaatttctaagaatcaatttatatggggaaataacatatgtttcaggattaagattaccattagtatggtatacctcttgaagagcattatctttgatatcgtaactaatatatttaaaagcaatatttttgtggttattaattgctttgattaccgtagttaaatttaataatagatcatatgttaattcattatcattttgatgttccgtatttaaacgttccatttgaataaccgaactaatcaaagctaatttattaactaaatcattcgctgattttttatcaagattgggattaaataaaacactgtcaattaatagctgcagctgtccatcttcaaaaaaatcctcatcaataatataaccccttcttctaattgtttttattaactgcttattactcaaacaataataaaaatcattaagtttttttattaaactatataccgttttaatatctagaaaaatctcataattttccaaacgctttaaaatatctttagcactaatcggctccctagcttccttaatgattttaaaaacataatacagtttttcacccataatttccttactcctacattatcgctaaatttaatggtatatacatcattctagcatatttgttgtataatcggggactaaagttatacaacgccggtaaataacgtcccagtctttcatcaattgtaatgtattcaagatgattatatacttttttatattgcttttctaataataagatatgacttgcaagatagtgataacgttcattactaaagtttaaacgtgtagccaaagccatgataaaatcattaagattattattagtaaacttaattagatgtcttaataaacaatacgtttcaattgaaaatccaccattttcaataatataatttaataacttatatttatatgtcaacatcggactataatgtttatccaataaaagattcatcatgatcaaatgattttccatctcatttaaaccctgagcctgatcaattagtttttttatcttactaaatactgctaattctaaatccttacgtctcattaattttttgcgaataattttaacatccatacttatattaataagatcatggatatcctgcatccaatatccttcacttatatccaataaatactgtttaacttcaataatatccttatctataactttttgataactttgctttttcatgatatcactcctttaactacttctattatagtaatttaaaaaatttttataccaaaaataagctaattaaaaaccgttattttggtttttaattattttgttaaaatttgtcgtaagaaaaactaaggaaatccatttcagataaaatgttcttccttagctatcaataaaatatatttatttaaattagcaaaaagtcttcaatcccttaacaattatgcgagtcttttcttaataacaaaatgaataattctttcaataaatagtccaaaaatagataagattaaaccaataaaaactaaatttaatgttatcggtgctaaatgtaataaaccactaaataataatactgcaccataaaaacctccagccatcatcgtacagataataattcttaacattgtaaaaggataacaagagcgtattaccgctgccatagaaatagttcctaaaactaaatacattaatgttactagttctaaatcatttattttccacattggtccaaaaatcatgatagcaatgaataaaatcacaatacttagtgcattaccagctgctttactaaatactttaggcaaaaaacgtccagtaattttacgagtatcagcttcaaaaatcgtcataaacgatggcattgcttcaatcaataaatcaattaatgtaatttgtaacggaataaatgggaaggcagtattactgattacacaaaacaacgataataaaatcgtataaattgttttgataaagaatacacccgctacacgcgtaacattattaacaactttacgtccttcgagaagaacatctggtaaacatgtaaaatctgaatttaataaaactacttgtgagatttgttttgaagcatcacttccatcagcaattgcaattgaacaatcagcttcttttaacgctaacaggtcattaactccatcacctgtcatagctacatgatgaccatcattttttaaagcttcgacaatcattttcttttgactaggagttacccgaccaaaaatagtgtaattacgaactacctcttgaatttcatcatcatttatcgttgacatatcaatgcaacgttcataatttaatacccctgcttttttagcaattgccataactgtatttacattatcaccagaaataattttcgcatctattccttcttgatgaaaatattctaatgtttctttagtattatttctaattgtatctgataaaataatcgccattagtggttgtaatcgtggcaactcttctttatcatcaacagtcttttcagtataaccaatggcaatcgcacgcattccttgcaacattaattcatgaatatcttcaggcagttcaccagaaataattttttctgctgctcctacgacgatggttcctatacctttaaattcaatcgcactccacttacgtaatgaagaaaatgggatctttttaacatattcataaagattattttctccaaaatagctattcatcgcttgaaaagttgcattattatcatcactggcacgcatatatgagcccattacttcatcgagtttaaaattctgagttgtttctaacgtatatgttttttcgaccttcatttttccatcagtgattgttcctgttttatctaaacacaaaacatcaacatgcgataatgtctctaatgaatataaatcttgaatcaacactttacgtcttgctaaacgagtcactccatttgctaacgacacactagttaacaagactaaccctttaggcaacattcctaataatcctgctgccgaagagacaactgcattaaataacgtatcttgtcgtaaatacattgcttcaacaaacaaaataattcccaatgggattatcataaaagtagtaacttttgtaactttattcattgaatccattaattcagaattcttctctttaactttttgtgcctctttaacaatagttgttgcataattactatcaccaacatttttaacccttgcataacattttccagaaactacactactacctgacagcaggtgcccacctatatttttatgaatcggatctgattccccagttaatagtgactcattggcctcaatcattccatgaatcacagttgcatcattacatacttgatttccactttcaagaactaaaacatcatctagaacaacttcattaatatcgacaattacatgtctgctgttacgaacaaccataattgttggcttagttaaaattgataattgatctactagtttttttgcctttacttcttgccaaattccaataactgagttggtaacaataattgccataaaaactaaatttgaccaagcctgaacaaatactaaagctacaaatattaaaaaattcaaaagattaaataatgtgcaaacattatcttttataatctgcccataacttttactgacaggcttactaactccgttaacttgccccttagcaattctttcctggacttcactatcatttaaacccactttataatacataggtaattccttttccatctattccacctccggatttctcatcattatattacactttgttgagcaagcatatacactttactaattcttaacattcccttaactaaaataaaataaaaaccacgcctaaaagacgtggttttctctgaggctataagcctatgttgcttgctcgcgtctcaaggcgcttgggtaccataaatcaggtacccttttagttggaatgatatactgttattatcagacgaatccaaattcctatagaacaaaaaaagacataggataaatcctatgtctcaatcatataattactaaatatcgttattagtgtagaatttctatttaacagttttaatttataaataagtaagttatttaatgattatatcatatttaattgtataaatatcaatcaaattatgatattaggtatcaaattatgatacttaccatcagtttttgtaatcgctttcataaagccgctgtgataaaatatttataatgaaggagggaaaaaagaaatgtttaagaaaaaattttttattggttccctaagcctgatgttcgcattaagtggtattggtgcggtacaggccgaaggagaccaaggatccaaatcaacagcatctaaagtagtagaacttgatccaaatggaaatgcatttttaacagatcttactgatgatggatatgctgaattaggaaggtacaaagtagagaaaatcaaggataatatttatcactgggatgagggaacaaaaaaacttcctggtggtgcaacagatgagagcggcgtaacaaataacccatcatctatgtattttgtactagaagaagacggtgtattattagttgatttaggaaatggctctgaaaacgatgaagatattcaaaatgcaaaaacaatcgtaaattcaatgacaggaaataagccgttatcaattattattactcatagtcatggtgatcatactggctttggacgatcagaaacagtattcgcagacgttgacgttgaaaaagtatatatcagtgaacctgattatgctgctgccgcggaagcaatcactcaatttgatagtaaaatcacaaaagttaatcatggtgatactgttaacatttatggtgccccatatgtattcaatgttgtcagtgctcataccgaaggctctcttatgattacagataccactcatggagcattatttactggtgatacatttggcagtggatttatttgggcactttttgaaacaaatggtggaaacccaattgctgctttaaacgaaggatgtgctttagctagaactattttaaatgaaaatccttctctatctattttagctggtcatcgctggcaacaattttgggaagacaatgcccaaagacctaacgaaatgtcaattcaatatttcaacgatatggcacaagttattagcggtctattagatggtacaactatttcacaaccttatccagaagttgcctgggcgcctgatgcaattgagctttcaagcaatggtgcaaaggctaaaatagatacattaccaaagtacgttgaagcttacaaggcctcagttaatgaaatgagcgaagcctatgtttacagtggtagcgataaattaagtattgaatcagtcaatgctgccgctgctgcaactttcgttgtttatcctgatggaaatttaacagatgaagaagcacaaaaatatattaatgaatcaggaataaaagatattgttgatcgggcggcaagcaaagtttatgttgctagacctgctaatggcatttcttttactgatgatgatgttataggttttgaaacgatcgtaggtaaaattggtgtttcaaataactttaaattaattgggattggtgatggagcaactttcattaatcaaaacttaacatcttatatgaactttgtatctggacttgctttaattaatccagctcaagggcaagaagttaaagtatctgttcctacttacttagtaactgatgatcaagctgttatcaatagttatgtaaaagcaaataatgctggtaaggtaaaagatggatattatgaaaacccagaaagtcattatgaaatcgttgttgttaatagcgatacaaaaacaagtgctgctgatgcaacaaaagatgcatggaatactgttttagaaaaatttggaagaattggtaactatagtgaagtctataaacaaacagcaacttggtactctagaccattactttctggtgataaagaagctgatcaagcaagaaaataccaatattttgattctgttgatgcaatcgataatattgagcgtcatgtagttactcaagatttagataaagatggtactgattcattatggtatgaatatattcctgaacaatctaaagatgctcaaccaggaagtgtcccagtagttattctattccacggtaatacaaatgatcctagaactcaatatgatacttcaggatgggcacaaatagcaagtgaagaaggtgtaatcttaatttgtcctgagtggcaaggtcatacatatcaaggatatacatacgatccaatgactgatgattctaatgaaactcctgattcagatgttattacaatgttaaagatcattgaagagaaatatccacagatcgatcaatcaagaatttatatttctggattatctgccggaagtagaaatacaacaaatgccggtctatcagatgctaaatactttgctgctggagctggtcattccgggccattcggtgcaagtgacttaaataaagaagctgttgctgctaataaagataaatatgatatgccaattattttcttcactggtgatggtgatgaatattgtaaagatgcatttgatacaacagaattaaatgcaggattacaagtagctcaactttatcaagaattaaatgatatggaagttactcaagttgaagacatcaaagatgaagatgcatatctatatggtgttccttggacaaaacgctatacaattgagccaaccgctgaaaatattgctaaaatcgatgttggtgcaattgaaaatgccaaaggtgtagaaatcagcatggctcgtatttatggttggggacattggaactatactccagatgctaaattaatgtgggaatttatgagtaaatatgctcgtgatttagaaactggtgaaacaattcgtttggatctacaagagccagatactcctactgataatcctagtgatactcctaacgatactgaaaaaccagcaactcaaccatcaacatctacaagtgttaaaactggtgattcaacaatgattgcaccatttgttattgttgcaagtttatcattatttgcattagtaactgttattaaaaaaagcaaagcaataagataatcacatacagttttaaataattatagaaacataaaaagcaaaggtttattaaaaacctttgtttttttatccctaattgactacaaaaacatattaaacagacagctatcttctttaataataaaaagcaactgcactaattacagcaattgcttataatttacttacctttattcattactttattaaataatttttcagtttcttcaaattgttttaagattgcatcattacttggtttctttacttttactgcatttttttcatcaactaaaatttgtaaattcttatcaatattttttaataacacaatcatctcatctaacttttcttccatctctatcctcctatatctccccatcgatttcctaaatattttttaccatcaattcgataaagaaaatctgttgtttgtgaagtatctgtcgcaatcactggctctagcatggttaatccaacattgacactacaatcatcaccaactcgggctgccaaataataattaccaacttttctaattcgatagtaataagtatttttaactttaccaatatcttcaacatcttggcgatcatttgttgcaacaccaaattcctcaagactgccagacattatagtaatccctagaatttgtgtatctattttcttatcagtattatttataattgtgaattgttttgccacctctaaaacaatttcattataatcactactgtcagcttttattttaacaaaatcttcatttgattcaaaggctgtaatattaatactatccatcttttttatcaacttttcaccattacttactttaatctcatcactaactacattgtctgtttcagtttgtgcatctattttattttcagacttattatttggttgtggtcttaccttttcatcatctgaatcttttaaaatatacaagttttgtttaccatcattaagattagaaataaccaattcccaagaatgacgatattcgtcattatcataacctttaaaataattaaaaattaaacactttttcacttcattatctttatatatttcgagaatataaccattaaccagctttagtttatcataatcataaaccgctccattgtaatctataatagctagtttaccatcattaaaagttatatgcaaagctccgtgagtaaaagttttcccattataataagcaaagatctgctcttttgaattattattttttacatctcgatggacaatatactgtcctgatatattcgttccttgatacacaattactttttcataattggttaaatctgcaactttataactatctaaattattaatcgttttatctaaaattccatattctgcgataatatctttataaatatttaactcacgttctttcatgatacaagcaaacttcccataataatcatggtatgtttttattttaacagactgtccccatacaataaatcctgcaataattacaattataatgatcactgttgcttttttattttttaaccggttatatacaaatagtgctagcaaaatacttattaatttcaaaactcgaacaactatgccaagactattaataatctcatagttatagtttaagcaagaaattattccaaaaattaaaacaaataaattataaaagaaatatatccctaaaccataaataattaaaagtgaaactctttcaaaattaataagacgaccattatattcaatcattgtaacgccttgttcttgaagtttatcgagcaaaacttcatggtattttgttacaatattagcaaaaccataattcatttcaattctattattatcataaataactttttttatctcgcgatactccaaggttcccaaatgatcaactaacccttgttcaccaatttcaacattgcgacaaatttgtccttttttattaagaataataattacaataaaaaccacgatcgcaacaatcaaacatgtcatataattaaaaatatgtttaaaccaaatcaatgcaaaagctgctccaaacagcatcataataatgaaaaatagactaattatgattttagcaatattctttttcacatattttacttccatacttaattacctcaaattaaatatggcaaaaatactgttgccaatcctaagaaaaagaaaaatcccaatacatcagttacagttgtgacgaaaactccgcttgctagagctggatcaatatgaaatttttccaaaataaccggaataaaataacccgcaatatttgctaaaatcatatttaaaaacatggctaatcccgttactaaaccaaaaactggatttccttcaaataacattgagcctaacgcaactataattcctattatcacaccactgcaaaaaccaacagctacttcttttaacatgatccaggttgcattctctttactcatttcacctaatgaaagccctcgtacaacgattgttaaagactgagttcctgcattaccgcccattcctgtaactattggcataacagttgcaagtgtaactacttgagcaatcgttccttcaaaaaagctaaccacggaagccgccattactgccgtaaataaattaacaatcaaccagggaatccgactcttgaccgattctccaacagatgaatctagtctttcttcagaatttactccccctaataaattaatatcttctgtactttcttcttgaataatatcaataatatcgtcaaactcgataactcctaataaatggtccatttcatcaactaccggcatcatgataaatccatatttttgaaatttttttgctacttcttcctgatcttcattatataatacagtttttacatttgtattagtaatatccagcatagctgtatcaaacgagctagtaacaatatctcgtaaagatacaacaccctttaaaatattttgtggatcaactacataaagataataagttgtatcttcttcggtattttcttgaagaaattttaaagttttttcaacggtattgcgcgcacgaatactaatatattccgtcgtcatgatcccaccggccgtatcaggctcaaacgttaacagtcgctcaacatcttctttatcttctttgtccatcttatctaagatagcctgtttttcatcttcttcaagttcaccgatcaaatcagtgatttcatcattagacatttcatctaagatttctttttgtttagcatctgaaaataatttcagtaaatcatactggtcatcttcatcatcttcctcttcaataatgctggcaacaacatcattaggaagattgtccattaatgctttaatactatcctcgtcttcatgaagaatatctaaaatatcagccggatgaatattagttattactttttttattgtttctggcgttccatttaaaagaatatccttcagctcatcgctggtaattgtatcgatcataagtttcctcctttattggggattagatacctgatcttagtggtaaatgatcctctagactatcgcaacactggggtacaggctcgactttcattttttaccaccttctttctccaagtcattttaacacaattatgcgattataggggactttttgaataaaattaaatagtaatttaagattctgaaattctttttctttttgctgaactaaaaagaaaaagagccgattgtagtgaccgcctaaagttaccctaactttttaggacactacaaatatcattgctcttaaataaaaatgacagattatttagttaattgtattttaaaaggtgcaataggtaaattattttctccaaaaatgcttatcttacaataattttgatatccataactaattgttctaacttgggcaggtcgctcaaccagcagtttattttctttaattatcccaactgtctcaacttgatgatctggtaattctaaaataaaattattaatacctctactgtgtaatttttgatcaaactcaattataattttagaattattttcaatatttattatcttcggagaatgcccattaaattgattatcataaaaaagttctttgattcgccaaaaaatacgatgaccgactgtttttttattttggggatggatattaaattcttccccgcaattcattgttacaactaaatagcaagcaggtacttctctacaaacctgctgctgggcatctcttaaaataggccagttatcattcttatcatcatcatattcaggtaattgcacaataataaagggaatttgagctttcatatcttcacgccaattttcaatcaccagttgtagcaattgatgatataaataagcatttttagtatcctcttccccttgataccaaataactgccttaccgctatattgacagatttttttaaacatcgtgtaatatagtcctgccggacgacaaaaatcttttttcccccgcggtcccggccatggtgtatgtccaacatctttttttaactggctcatattacgttctggataagtttgctgatataatgccactttttgctggtactgcttaacacgctctttatatttagctatttctaaatcttcttgtgcttctgtttgattcatgattgcttgataatattcatcatagtatacttttttgatttcttgatttttttgaagatatgtttcatttatccagcaagaacctgatgtaccacctttattaactgcaattaatccgattgggatgtctatatcatgacgcaaataataagcaagataataaccgattgctgaaaaatcattaatcgtttgattatcacatatttgccagccttgatttctaatgggcggtattttgatattttcatcttcatattcaatttgtggaacttcataataccttaaatatcgatcatagcatacttcctgatcaacttttactgaatcacaatctttaaatttaaattcaatattagattgacctgctaaaaaataaacatctccaattaaaatatttgataacgtaatagtttctaatccagttgaaactattaatgtttcatccgtacttatttctagcgccggcagcgtaatcaaccaattattatttattattgttgttgttgcggtttgtccctgaatagtaatagttatttgttgatttgtttcaccggttccaaaaatatttatttctttgccatgttgcaaaaccattctcgatgtaaagatttcagctaatcttagtttcattttttctgcctcttaataaacttactctttttgtctccaccgcttctaatttctcggtttcagtcattttatctaattccattttatcagctattttaacaaatgggtaatatattgccattgatataactagatttattagttgcactaacccgcctgcaattgttccagtaaacaaaattcccgaaataatcggtggtactgtccaaggaacattattacatactactgggataaaaccaatcttagtaaaaaataccgcaatatagaaacacaatggttgcacaataataaagggaataaaatagattggatttaaaatgattggtaatccaaatgtaattggttcactaatattaaaaattgctggagctaaagccactttggtaatctttttattttgttttagttttgagaaaaataatatcgataatactggtgctaaagcaaatgttcccgctgcaatagttgaataattcataaacatcgttgtatataaatgtttagcaacacctaaaacattttcgtttccagcaatatcccaggtcattccaaaaattgctccccaaatagcagttggatgaattcccagccactggaataatggccatgtaatttgggaaactagagcaaacgctgcggttttagatattgctaaagctggtgcttgaagcgttgttaaaataaactccggtaatgattcaccagcaaaagtattactaataacggttgcaataataaagacaaataatgtcaacatccccggcactaaagattcaaaactctgagctacagctggaggtaccgaatccggcatctttattgaaatatttaacttagataatttattaaatataaatgtagcactacctgcaacaatcagtccaaaaaagattccttgttgacctaaaaaattcgaattaataattccattaatatcgacctcaattcccttagcacttgtataattaaaatcccaaggcaaacaaataaaaaatgctgctaaagcatacatcactgaaaccatatgctcacgattatcactaaaatattttcttgagacattatatgaaaaaatcaccacaatcaacagagcgttgatcgacatagcccctttactaaaaaaattaaaaatattttgtccttgtactagcatttgagcaaatcctgatgctaagaactctttctcacttccaaagatcatctcccctagaccaagtccagatgaaccaaaaataatcccattggggtcaataaatacagaactgatcataattgcaaatccagcaattaatgtcagtgaagcaaccaatacaaaagaatccctcaatacatttaaaaagcgatttcctgatactttacagatcagtgcagtaaatttatctttcatttttctctccttttttgttttagacatctccggataatgtccaaaagccctcttgtgtaaaagcgtttacattgcaattatatcactgttgagaaatttatcaatattattttttgttatgggaattttctctattgtaattaatttggtttatcgatataattataaataagaaaaagaggtattaatatggactttaaaaaaacagttgccattcattatactgagtttacacctagtgaacgtaaaatttgtgctcgtatcttagaagatcctcaaatcgttaataactccattgttgttttaggcgacctttgtgaaacttctaagtctgcaatcctacgtttctatcaaaagcttggataccgtggatactcagaattcaaatattctgttgaagaaagttttaaaaataacgatgaaaaaaaactcagcaacgaatcattactgagtcagatttctcaagaatacagtaatacgattttagaacttggtgctctagattatgatcatcaactaaaagaactagcatcattgattgacaaatatccacatgtcttatcaattgggatcaacaatacctattttgctgctagtcagttagaatattctttatactctcataatcgctttattcaaagtgtacgcgaggatattcagcttacctatctaattaactctattaatcaagattatctttgtattatctatagtgtttctggttctacttatacttatgaaaactttattaaagaagcttctgctaaaggtgcaaaaatagttttaatcacgattgatggtaattctgaattattacctctagttgatttagcatttgttttaccttcgatttccttaccaattagcagtatcgattctattattcaaattgataatcgtattatgttatattatttttctgaaattatctcctattactatggattaaatacgcaaaattaaaaatgctatgataacatagcatttttaatttatatcaacttattcgtaatttcttcttcactttgaggacgtccaaacaagaatccttgaatataatctaattccatcggttcaacaacattaaattcctcttctgtttcaattccttccaacaatacctcaatatcaacatcgtggcaaatttgagcaataaaacgaataaaagttttatcaaatttactaatcttaatatcacgtacaaacgtttggtcaatcttgacaatatcagcaggaacagtctttaaaatttccaatgaggcataccccgttccaaaatcatccattgcaattttaaatcccaattcgcgaagctgctcaaaaattgttcttagtaaatccatgttcctaaccatatagctctctgttaattctaagacaatatttttaggtgccagcttttcttttttcagaaccttttttacatcttccacaaaatcactatttaacatctgaagcgcagatacattaatactaacagaaaattcaggatcatatacgacccacttcgaacaagcctgaattgctttctttataacccatagaccaactgggataattagcccgctctcttcaagaatgggaataaattcaactggtgatacttttcctaattcttgacactgccatcttaacagtgcctcaactcctttgatttgtttactactcacctcaacttggggctgataatttaactcgaagccacgataatcatcacttacactttcacgaatatattttaaaatttctaatgaacgcatcttatgctcaaggatgtagtttgaaaagaaagttaatttattttttccattatccttggcatattgtaatgaataatcagcatatttatttagttcattatatgttaacccatctttaggataagttgcacatccagctgaaatttgaatcggacatttataacgttttaatagttgttcatgcaataattgtttctgtatctcattatataatttagtaatttccaattcggtactattttcaatcaacagccccatttgatcgctatccaatttataaatactagtattacctggcaaaactgcctgagtcaattgggctactgttttaataataaaatctccaaatgaacggtcatatatttcgttaatatttttaaagtcatcaatatcaataaccataattccaagattatcgattgctttatctttagtcttaagctcaaaagctttcgcaaattcttgacgattatataaatgagttaggggatcaattttattttgacggtctaactgtgtcattattccagcaaataaattaggctcaccaaattcatcgcgcattaactgtccacgacattttaaccaaatatactcaccatcactattcatcgctcgaaattcaacagaatgataatccatcttattttcgccaattgccatatttgatttataaaaacgttcccaatcttggggatgtacgattgccttccaaaatggtaaaggatggtcaataatttctcctggtaaattaaaaacttttacttgggctggtgaatatctaaaaatacctgtcttcatattacatatgtaaataaaatcatcagtacttttgatcaaagcttcataaagttgtgttggatcatattgaaaacaagctacattagtagatcctactgaaacatcttccaattctgctaactgagttcgacgatatcgcaacttttcctgatacatttgttcatctgctctagttatcacatcattaacagtcaatttattagttggtaaaactgtatacattccaaaagcatatgaaaatccgtaaggcttattgtataaagcttgcagcttttgtatatttttttgattctcaattaaaaatttagcactatccttagtatttttatgcccaaaaactagaacaaattcatctccacctaatctaaagataagatcttccttatcaagatcctgctttactgcataagcaatttgttttaataaaaaatctccttcttgatgaccaaaagaatcatttactctttttaaattatttatatctaataaagcaattgtaaagctttctttagcttttttctttttcaccataaactcgagcagtttttcttttccagcacgacgatttaataatccacataagtcatcaatactagcctggtgacttaggatttcagaatcagtaatatcgattgactgttgcatgtgaacaattttaccattttcccatttaattaagctatcatagttttcaaaaatacgattagtaagatcactattttcacgccagctaatcgactgatataaattattaatttgttttaatttgataagtggacaaaatggacatggtccgctttgattcttttgaagtgttttccaacatattttaccttctggatctttcaaattataagtttctttcatcttattattcataaaaatgatttcatttgtttgaatatctgtaagatataaattaatttgcatattatctaccagctgcttaaaatcatcaaaacccattgttaacactcctttactccaaatttcaactatctttattataccatactaacaattactaaaggtaaaaactatttttaaattataaaaaacattagttatcattaaatataaaactttatccccaaaaaatttgaagatatttgctttggacttagataagaaaatgacgagtatcacaaataatgctatactttaagtactattaataatttagaaaggataatttttatgaaagaagatctaataattgaatggtttcaatcatggtttgattcccattggaataattttgaagtgatttttgaatccgatgcttattatagtgaatcttggggtcctgaatacaaaggaatcattgaaataaaaaaatggttcaatgactggcacgaacactttaaattagataagtgggaaattaaacaatttattcacactaataaacattctattgttgaatggcactttagttgtattgacttagatggcgttcatgaatttgatggtatatctttgattgaatggagtcctaatagtcttataaaatcattaaaagaatttggatcatcacttcctaaatatgatccctttgagcaactataattaacacagggagagataataatgttttataaaatatatcatgatacgattccaccgtatcttttagaaatcatgaacacaaatatctttactcgcctcaaagatattggaatgaattgtggaatggaatatacacagtttcaaacatttaaaaatagttttggagtttcaagatatgatcatagtattggcgtttctttaataacttatcattttactcatgataagcatgctactgttgcagctctattacatgatatagccacccctgtattcgctcatgttattgacttcttgaataatgattatgaaaaacaagaatctactgaagctgaaacaaaaaagatgatttttaatagtcgtgaattacaaaaaatttttcttaaatacgagatagatattaatctaatctatgattatcataaatatccaattgccgataatgaaagtcctaaattatcagctgatcgattagaatatactcttgcaaacgcatattattataattttttatcagtcgaacaaattaagtcaatttattacgatttaataattaatgataaaaaagatgaaattatctttaaaagtaaagataaagcaataatgttgacaaaagtaatgtttcaatgcagtcgtgtttacacctctgatgaaaatcgatattgtatggaatatttagctaatctattaaaaactgcgttgacaaaaaagcttatcacacaagatgatttatatactaatgaaagttctgtcattaaaaacatctgcaaagacaaagaattaagcgataaatgggaagctttttgtcattttcatcaagttgatattagtcataataaaaaagcaggttattataaaataaatgctaaacatcgctactttaatcctatgattggaaatcagcgaatcatcaaccagtctcccaaatttaaaagtgaactaaacagttttttaggagatcattttgatcgttatgttaaagttacttaaaataagttattctcaaaaaaaacaactgctaaataaagcagttgttttttattcaattgggcgttgataaaaaccgccaaagaaattttccgtaggaataacattaattatcgccttttcatcagattcatgcattaattgaacaatatcttgaacctcataagcagatacaaccgtatgaagtaaactcattggatttttactataaccaccataaccattaacaactgaaacaccatgacgataatctttaacatatctttcaattatctgttccgggtgggttgttgtaatctgcaatgttacccgcttatacctttggtaaaatgatgagattgttttggttgaaataaactggaagacaattgaatagcctgcatatatccagccaaacatataaccaaagatacaaagaatcaaggcattgaaaataaaaacatactcccagatggatttacccattttattagaaacatataaagcaataaaatcggtaccagctgatgaagtattccctcttaatgcaattactgtcgacatcccataaacaaatccaccaaaaaaaacatttaaaataacatcattaaataacggtgggaatgtacaaatccttaataaaaagcttgttaaaaaaacttggcacaaagaagaaataacaaatttctttccaatacttttaaaacataagattgctactggtacatttaaaacaatcagtcctaaagaagtagaaaaattaaagccatataatgaagtaattcgatcaattaaaattgctacaccagtaaaaccaccagataacagattagctggttctacaaaaactttgatagcgtatgtttgcaaaaaagaagatgcaattactgctacaatcgttattagatatcgaaaccagagtttgtttttcataatcctaatttcactaatttttcaactaattccttactaaccatgtcaaaatcatctttatgctctgccggtccatagcaatagtttacaaattctccacttgtagttggatcattttgccaatctttacatgaagaatgaatttgagcgattcctgtatattccataattgcttgtccgtttgtactgttaattccacttccagctaatatttctattttatcgccatactttgtttgtaattttttgattaaatctttaccatcagcggctttagctcgtagtccgctcgtaagcaagcgatcaatgcctaaattaattaatatctcaatactggcatatgggtcttttacacaatcataagcacggtggaaaaccgcttctttttgataagactttattagtgaaaccatttccttggttctttcaatatcaatttcatgattttttaataaaaatccaaaggctataccatcggctccattttctaatagatccttagcttctatcatcatctgtttaaattcaatatctgtataacaaaatcccgctccacgtggtcgaaccatgcagattacctttaagtttgtagtattttttgtcaattttaatgaaccaatgctaggtgttagaccacctaaatgtaaggcactattcaactcaattctttttgctccaccataatatgcatttagagcatcttcataacttccacaacatatttcaatcactctgcatccctactttcattttgctagattatataaacttaaggcgtaaatcttagcatttgtaataatatcttcaattgtcatccattcattaggttggtgaccaattcctttttgaccaggaaatgatggtccaaaaggaacaatattaggcatcaacttagcatatgtcccaccggttgtagtaactggtgttccatcatctccagttaccttttcataagtatggactaatgtctttactaatttacattttagcgggaattttacaggatcataatttcccactaaattaacttcaaaattgctaactaccatctttatattattgactattgtttccactgtgacactcgctggataactaacactaaattgaatacttggatctccgtctaattctaattgataatttcgaacttctaataatccaaattcttgatcttgaaaatcaatattaaacctttcgccattatttttagcatttaaaatataattattgaccaaatcaaagaattcttttaatctatcctttttcccgcatattttaattatagcccgtccacgctcaccataaacaacaggatatttacaatctggtgtaaatcccattaacggcggtctttctttacttaaataatattttaaatcttcaaaaccagattcttcatcacaaccaaagataattctaatctcatgagctaattcaagttttaattctttaagtgcataaagagcaaatagacatgataagattggtcctttattatctaaaattccccgactataaatcaccccatcttctacatacccactaaacggaggctgtttccagcctgtcccaactggaacaacatctaaatgaccaatagcacaaatataatctttactttcaccataacttgcatatccgatataattatcaatatttgttgttacaaatcccaacgaagcagctaaatccaaagcagcatctaaagctgctttgacccctgagccaaatggagcattttctaaaggagctgtttcaacactatcgatttttacaatttcaataatacttttaatcatttgttcagcaatatcatcaactttttttaaaattatatcttccatcttatttttcttctaaaggggctgttcttgtagccatataattatctaaccattcttgactagctaccgtatgtatacattttccatctttattttctgtcaaataaacaattggttcttggtcagcagtagcaacagcaaatgaaaatccttcaatatttgtagcaacaccccattctcctttattattcattgctaccaaagacatatcacctgcttgaccacggcgttcttttaattctaaatcaaacatattaaccgctttttcacaagcagcctgaggatgcattccatctttcattaaacgaacaatttcataagctacgcaccctttcataacatcctctcctaagccagtagcacttgcaccaccgactttactatcaacatagaagcccgatccagaaatcggtgaatctccgacccgaccagcttttttcataaataagccacttgtagaagtagccgaagtcattttaccatgagtatctaaacataccattccaaccgtatcatgtcctgaatagggtttaatttccaatgcttgaacttcttttacacgattacgatagtgaattttagcacgatcagtcaacatattctttctttcaaaaccttctttatgagcaaatttttcagcgccttcaccaactaacaaattgttcactttttcttttgataatcgtcttgcaatacttactggatttgcataatctttgattgccgctaccgcaccaatatctaatgtatcaccatccataaaagccgcatctaattcaacttccatttcttcgtttggcaacccgccatatccaactgacttatagtacggaaagtcctctacctctctaaccgctatttcgattgcgtcaccagcgtcaccaccttctgctaaaacttgacttgctttactgattccttctacggccattcgccatgttgcaataataccccacatctaagagttcctcctttattttttgataaaaggatgcgttatccgcatcctttttagtttagaaacaatactttgaagtaatcggatttagatcttcatgatcaactaatgctttcgctaatttgcacattccatctaatgattcatttaagccaatcccacctttttttggtgtttcaataatatgaattttatctttaaattcattaatcgtttcttcattttcttttgacattgctgcaaatgcaggaatatctgttgtctgattaatatcataggcaatattagctgccatcttgccataacctaaatagttaaatgctggtccacacattactacatcaggttttaacttattaaccatcgcgcatagtttacgactaacttcttcaggatttgcttcataatacccatcaccacaatataaacatgccatcacgcgtccgtcaactgtttttaaatattgttccatcataattgctggtccaaccggttcttttttagctcctaaaggaatcatatggtcatctttgattcctgcaccagattgaatttgatcataaatcataattactttcataaaattgcctcctataaatcatcaaatgataagtcatctaatgaaaaatcgtcttcttctgcttcatgaactgcattagcttcgtcgttaatatattgcttatccataattttaataaacggcatgtaaataaagattcctaatactagtaagactgcttgcaaaatagcaccaacccagttagttgccaaaaatccagaaataattactggggttgtccatggaatattaatccctgagcaaatcggtactaaccccgcagacatcgcaagataagaaataataatattgattgttggcaccaaaataaacggaataatcattgttggatttaacacgattggtaacccaaatacgattggttcattgattccaaaaatccctggtactaatgataattttcctaattctgtaattcgtttagatttacagaataataacattgcaataatcaatgataatgttgaaccacaacccccgaaagtcgcaaataaatcttggaattgttgacaaataatatgtccttcaccaacacccgttttaaagaattcaatattttctactgacaatgtttgtaagattggattaaatacagcaccaactactgaacccccatttactccgaagaaccagaataaatgcaagaagatataagcaataatcatcgctcctaaagtatctcctaaattaagtaatggtgtttgtaagaattcaaatataatttgaaacacatttgttcctaaaaaaccaaataataagttaattgcaaagaagaaagtcattacaacagttgctggaattaaagccgcaaacgattgtacgacagtaggcggtactcctgccggcattttaattacccagccttttttctcaacccatgaataaatatgcacagctacaaatgcacagataattccaacaaaaataccttttgccccaacccatccagttgggatacctgttaaagatactggtatttctttacctgccatttctacagttccttctaccgtataaggcatgatcaagaaccatcccatgatagctaccgctgctccaaatattttatcagtcttcatctgacgagcaaatgaataagcaatccctactacagcaaagactgccataatagtaaaggttgctcctgatggcttttcaataaaagcagctaatgtctcccctgtatttgaattaatgactactgaacttaaccattctgtccatgcaggaattggaaaatttgcaatcagtaagaaaattgaaccggcaatcaataatggtgttgatactaagaacccatcacgaattgatactaaatatttattacggccaatagcttcagctaaaggcattaatattttttcaagttgtttaatcattcttttaccctcctttttatttatttgcttttatcagtctaatcgctgatttaagaactttttcaccattcatcatgccataatcaccttgatcgattacagctataggaattccttggctaccaaattgttctaccgtttcctcatacatgtatttcacttgtggtcctaataaaatacagtccggacgatcctctgagataatctcctctaatttattgtggggaaaggcagcaactttaataggtaaattatgttgattagcaacatcctgcatattacttgccaacatacttgttgacattcccgcactacaaaatagataaacttttttcatttctttgtcctccctttgttattgttaatatttttctaatgctttgacccgttcatttaaacgaataatttctaaagccatgaccttaattgtttcagctgacattaattgatcttcggcatgcattaacagaatacttggtacaacatgatttccactagcttcttgttgaatcaattcactatgggctaagtgtccaccgttaaaagattcttcaccttccttgatttttgctctagctgcatcaaattcaccattagcagcaaccttcattgcttcgataaaacttgatttagccattcctacagctgatataattttaaaactcactaactctaaaccatccattttttatcctccaatacccttacaatcaacattataagtaattaatttttttattgttgctagtcatctttcctagacttaggaaattatttacatagcactactttagtatttcctaaataatcatgcaaagtacgatgttctcctttaaataaataaagtaaaatactgattccactaattataaatcctgcatacatcaaaggtgtaacaaaatttgtttgggtaataatcgtaaccagttcatgccagattgcacttgcagtatataaaacaccctcaattacaataactcccaataattgtcttaatagcatattttttattgttacttgctcattattcactttaacaattttgattttacaaattttcttgccgagcgtttgccccggataaatataagctggaacaattacaaagtaaaaaattgcaaataaaacagctaaaattcctgcaatgatcccatatggctgtttaaattcaacaatgttttgatttaacattgtattcgttaacttttgtgaaataatcgcaatcggaatcgcagtacataaagccccgacataccagtcaattaaatagcttataaatcgttttactaatggagcatcttcataccttatttttctttcttttttcgcttttactactttagttgccatctttctctccttacattattacttgttccataaattcttgatgttcccgaacttctaacagttgggtgaatttatttgaatcactgacaatactactcaaccagtcaaaaaagattttcaataaatgattatctgtttctctgattgcaagaagaataatcaatttcacttcaaaaccaccccaaatcaccggtttatctaaaattaaagttgatatacatgattcatttgctgatacttcaattgaatgtggtaccgcaaatccatttacaaaagaagttgcagaaactgcttcacgcctaaaaacatcttctttatagctttgtgttgctaaccctttttcaatcagttcatcacataaataatcaatgatttccttaggattattcatagtattttttacatgaaataaatcttcacgcatcaattctttgatcaatgaaacaaaatcatcatgatagcgatgcttatctaaaatatttagtgtctgaaatactttactttcatcttcataattaataaataaagttacttggactgttgggatatttaaattatgttttagtggtactgttgtaataatcaaatccggttcttcttccttaaccatcgattcttcaaaaaagccatagctttgaacaatcatcattcgttcttcaaaacgaatttttaacttgtcccgacacatctttgatagcatctgattattaggaatgatcataatcgcacgatagcgttttaaagaattgacccgatcgtacgctgctcctaaatgcaaagctaaaaacgctaattcattttcattaatattaacctcacaagtttcagctaatacctcgcctgcacgcactgccatttcaaatactaaaggatacttacgtttaatttcttgaagatagacattagttacttgaacattatttttttgacgctctaacaatgattgtaagtgcattgctaaacccacttttaaatccttatcttttgaaaaatcaatatcaaaatattccttaacttcaacaattactgcttcaactaaatgttcaacatcgactgccagcttttctttgataatatccttacgataatcatttgccctttttcccattaataataaagcaaataaaattacttcatcagtaacaagttcaatattgatcatcgtactaacctgtgtaaagaagtcatatgaaatctgatattctcgactgctttctaatttttcactaattgtttgattcttaatatagttatgattaatgatccgctcaatcgccactccggcatgaatcatgatcattggaaaagtcatctcatgaatctgataatcatatttttcacaaatttcttctagtatatctttcacttctaatagatcaaaactattccataatcctgcaattgaatttaaattcataaaattcccttgtgtctctgccgtcaataactgtttgtataactttcgcttatctgtttcatttccttctaaactaatataatttttagatctaactagttttaaactagggtaatcattaatcattttacggatcttttttatatcattatcaattgaataaccacttacaaaaacctgatcctgcaaggcaatcaaattaatttcatgacttttaaacaaaagttcttgaataatatatatacaacgttcttgggaagtttgtgggattatatctttagtttcaatatcctgcttatgcaataatgtctcatctaaacgatatcctagacgtttattagcctgaatcagtatacaatcataataattattaatattctctatatctgaacgaattgttcggtcagatacatttagaacttttgcgatttctttaccagtaatccattttccataatcatttaaaagatcaataatatttgtttggcgtttgtttagcatttctttatcagctccttttataatatatcacgcattcattttcctaagttgcaatcttttttcctaactgttaggaaaaatatccaggttaaattataacttatttttctatgcataacattgttaaaataggataaaatgagttaaactatagacgaggtgagaatatgataaattttattgaatatccaaaatgcagtacttgtaagaaggccaagaaatatcttgatgaacttgggattgatcaccatgatcgacatatcgttgaagaacgtttaagcaaagaagaattaactgctttgtatcaaaaaagcggcttaccgctcaaacgcttctttaatacttctggcttaaaatacaaagaactccaattaaaagataaacttcccacaatgactgaagatgagcaattagaattgttagctactgatgggatgttagtaaaaagaccaattgttgaaactaaggatagtgtattagttggttttaaagccaatgaatacgataatctaaaataatgccggcagcttatagtcattatcgtcttggacaactagtgcttgataaattaaatcagccccttaaacgtgtcttggaaactaatcaagatctatttgatattggattacatggtcctgatattcttttttataaccgcccgtatatccatagtaaaatcaatcgtttaggtagtgctatgcataaagaaagagctgacatctttttttaccaagctttagaaatcttaaaagaaaccaaaagtgccccacaatttgcttatctttgtggtttcatctgtcactacattcttgatagtaactgccacccgtatattaatacgattatcaaagaaactggtgtaactcattttgaaatagaaactgagctcgatcgttattttatggtcaaagatcgtttagatcctctaagaactaaattaactgatcacattaaggttaatgatcatacgctcaacaacattgagccatattttaaagcaacaaaaaaagaactctataagagtcttaaagggatgaagttctatgatcgtttattattagcaccacagttttataaacggggcttgatttacctagttttaaaaatcacgtttacatataaacgattccaggggtttgttgtaaattacagaccaaataaattagtcgacccatacttagaaaagttagaaagtttatttaatcaaagtattagtgaatcatatgaagcaatctacaattttattgatgtaattaagtatgatcgttctctatcatgtcgatttgaacataatttcaaataaaattattgctttttaaatataatctatcgaactgttcattataaatgaacagttttattattaataaattgtaattattcttcgaattacagtataatttaatcaaaagatttcttagataaatatttacctaatcttaaactaatcatgctcgttcaacaaataatatctttatataatatccaagaatgggaggttaactatgccggcaagttatacacatcagcaatttgggaatcaagttttaaataagcttgaaaatacaacaattaaaaaaattattaatgataatttaaatctctacaatattggtcttcaaggccctgatattttatttttctatcaaccgcttaaaaaaaatcctgtcaatactttaggtaatcagctacaccaagatattgcacgagctttctttgaaaatgcaatgaaacttctaaaagaacaaccaaacgaaaaatcattagcctatattttgggttttattaatcactttattttagatagtgaatgtcatggttacatcgataaaacaatgattaatcgtgaaattggtcactttgaaatcgagcgagatttagatcagcgatttatgatactaaaccatgaatcatttaactattcaaccccaaaacattaccagatcaatcttgaaaatgctaaaattattgctccgttttttaatttagctccagccacgatcttagcttctttaaaatcatttaaacgctttaatcatctttttgcttgccggagtgttttaaaaagatccttgattctaacaggaatgaaaattgttaatgctaagtcatactgtggaatggtcatgactgcaaaaccagaaaaaagaattgaagaaaacattgatatattagttaatctttttaaccagtcgataaatattgccacaaaggagataatcgaatattattacagttaccagaacaatactgcaatatcaaaacgattcaattacaactatgaataaactaacaaaattagaaaagtattgggttttatatgatgtcggaaattcagcatttgtattattagtatcaactattattccaatctattttaaaaacttagctactgaagccggaatatctttaagtgattctactgcttactacagctatgctatttcaatttcaacattgattgttgcattagcaggacctatgctgggaagtattggtgatcgtaaaggtgtgcgcaaaccaatctttacattctttatgatgatgggagtattaggcttagctgccctttctattccagttggctggattgtatttttagctatttttatcgttgctaaaacggggtttgcgaccagtttgatcttttacgattctatgctggttgatattacgacatatgagcgggttgatcaagtttcttcacacggatatgcttggggctatatcggtagttgtattccttttacaatcagtctactattgattttaggttgtgatacaattggcctttcaactgttatggcaacagcaattgcctttatcatgaatgctttgtggtggttttttattactatcccattattgaaaaactatcagcaaattaattatacaaccgctaaagaaccaattattaataatttaaaacgtgttctaactagtattaaaaataataaaaaggtactcttcttccttatcgcattctttttctatattgatggtgtttatactattattgagatggcaacttcatatggaaaagatgttggaattgatgataatagtttactactagctttattacttactcaagtagtagcttttccattttctttgatttttggaaaacttgctaaaaaattccctgttaaatcattgatcctttcttgcattattggatactttttcatcgctgtctttgctttatggcttgatacagcttggaaattctgggtattagctgtttttgttgctgtttttcaaggcgcaattcaagcattatcgcgatcatattatgctcaaatcattccagaaagtcaggcgagtgaatattttggaatttttgatatatttggtaagggagcctcatttatgggaactttattaatggggattactactcaaattacagataattcaaaatacggagttgtggtgattgcatgtatgttcgttattggtggcattattttcaagtctaaatgccataatcaagcagactaaagtctgcttttttattatcttacaagtctttaaagcaaaataatgataaaattaaaaaaaggggaaattattaatttacttgataaatttgattactatatgatgaaaggggaaatcaatcatgttacgactaaacaaatttaccaaaataacaagtatctatattatcaccatgatgatgattactacaatcttcacttactttggctattatgcacataaagcaacaataaaagatgactggccaactaaatatgttgctgatgatattaatgatgatttaaaatataactattcacagtttacagatgttgttatagctaatattgatcgaaacgtcacatcagtttatctagcctttgatgaagattttcaaccattcttagcccctcatgaaagatggcactttgctgctaaaaatggtgataatattgctgaggtttcactcagtgaaatcagctatcaaaaattaaaatcaatatgtgaaaaacttattgccttgatggatgaagataagactaaaacaatcaatgtaacttttaattattctgcaattaccgataaccatattatcgtaagtaatttagtttactttgcaatcaatgacgaagtatatatctctaatgactctactgctaccattacttgcgaactcacaaatctatatacaccatttctagatattcagattccatcagatgaagactggaatggttattattataattcaaacattaaaatatataactatttagaaaatttctttaagcaaaattatacaaaaactcaagatgacggttactataaactatcgacccctgatgatgatccgtttaaaataaataacgaagcagaagaaaatgcatataattttagttactgtatccaaaaactgtcacgcgaatatagtcatcatgactcattttcagctaaagaatttgattatcctgatgatcgtcttggctatctagtctggaatcaagtagacgattattatcaaaaatatactatttttaattattttactgactattactatatatatcttcttattggcataactagtattctctttattttaatcttaaaacgaaatatcatcactttaccacaatatgaaacaattgttcttaatccagttcccgcagttacaccaaagaatgttgaagatgttgacattgaaccgattattactgaacttattgataatagctcaaacttattacaatttaaaaaattgattttatcatatcagcctcagacaactattattaaagggaatcgtaaacaaataacaaaacttataactactttatataattttgcgattagatatagtgctagtaatgataatttatcgattatttttatcgaaaacggactatccttcactaatgataattttacttatactactgaaaacttaactgcattaaatgactgtttagaaattattaaaattcataattatgagtatacttttgaccacaataatttattatttaaacaaataattaaaggagcaaccgatgaaacgaatccactttaataaacttgctaaaataatgattcttataacttttagtatcgctatcataataagcttttttacataccaagattatcagaaggctaaacagatctataaagacgattcacctgttaaaattgttgctgatagtattaatgatgatttaaaaatttcttcatatcatgttgaagatgccgttaatgcacaattcgagcgtattcttacaaatacctatattgtttatgatgaagagcttaatccctatttaccagccagtgaaacttggtcaatgactataaatagtaataataaagaatcagttatctcattaaagcagctaaattatgatcaattaaaaattttaagccaatatctactttctcaagtatcagaaaataatattgaaacaattaatgttacattaaattatgatcaaaacaacaatgattttattgaagtttcaaaactatcatatttagcctttgatgaacaagttattttagggcaagcaaattcttcaacaattacttgccagcttgtcagtctagactgccctttaattactatttatgaatatgatagcgactatgcttacaattataccctgtaatcttatgaaaatttagaaaaatgttttaaaaaaaattatcaaaatcttgatcaaaacggttattatcaaaatattgattctaatcaaaagcagattctagaaacaacaagtacaattacatcaagtatttgtattcaagaattatcaggaaaatatagccagcatactgactttaatgagctatatggaattaatgattttaatgaaaaaggctatttagtctggtatcaatttgatggtttatttgaagagtataccttttttgattatttagcaacacactattataactatttattagcgctcatccttttagggatgatctatcttggagtaggaataatttttgctgaaaaaaaacaaattccagtttctcctgattctaaagcttcgagttttgattcgattccagaaaatatagaagaaatagatatttcacaactaatcacccaattagtacacaacagtgctaatgtgttgaattttaaaaagataaagttatcctataaaccacaaatgatgattatcaaaggtaatcgtgaacagataattgatttggttacaaggttatataatttttctctgcgccatagtaatcaaaacgacgaactaattattgaattaaatcatcataaaataactttttcaaataataattttaattatcttgatgatgatctaaaaacccttaatgactgtattgagattattaaaagacaccaatatcactattcttttactaatcggagcttatcaataaagatcggatcatgaaatgaaaagaatcgatattagctatagagctaaacttatcactcttgcttttacaataattattagtctatttagttattaaaattatattaatttttcaataaatcaccaaaatgagaacccagtaaaaaattagctaatgctgttaataaatccaagcgataattagaaccagtatttgtatcaagaaaaccatttgcttgcgggaatgtttttaatggcaatcatcattttaataatcaaagataatacaaataaagtagtcttcatttcttcaaaacaaggcttgtctaacaaaataaaaaatttttacttagatcaatatattaataaattaattgataaaaatattaatcttgttttatatctagcttctatcataattactgaaaaaaactatgataattattattgttgaacagctatttaatttcataattgatcatagtttagcagataacaccattgcaagacaaacattatcttttggattgcctattactagtacgattccatttaataaaaataatttagttattttaaacgaattaaaactattcctaaaaacattaaaatataaatctaaatttgttaataacactgatagttaccaaatacttattaaaaaacatagagtttttaccctatgtctttttatctaaattgattaaataaataatgatacaacaaagtatggcattcctacaacaaggaataatccgccaaccattaatgcaccagtcaatagcattaataaagccaatttgaaaacacaaaatacatcagtaataaaatattttgtatagtttataatctttcctctatttacaatacttggggtattatgaggataaatatatgctgttttcaacatatataatcactccctttctacactgatatcgtagcatggaaaggaataaattttctatttataatcttagccctaaatataaagattatattaatattattcaacaaaccgatatcctaccccaacttcagtaataatgaaatgtggtgaggaactatcaatttcaattttacgacgaatattagccataaatactcgtaatgattgataatcatctgtagtttcatatccccagacattttcttgaataaaatgatgggttaatacttttccacgattagtaatcaataagactaacatcttatattcaattggtgttaaatgaatttcttgatctttgacccatacgtgtcgtcgttcaaaatcaactttcaaataatctaattcaaatattggttcgctaactttttcttttaagcaatgccgtagtgctgctctaattcgtgctaatagttctgcggcattaaaaggtttagtcacgtagtcatcactaccataatcaagtgccataactttttcagtttctgatgaacgagctgaaacgacgataattggtatacttgaattttgacgtatttgtttaagcacctcaattccttcaatatccggcaaacctaaatcaagtaaaactaaatctggtcgattggcatagaaaagtgataaaccgcttagtccagtttcggcaataatatagttataattttgagtttttaaagttacttttagaaagttttgaattgttttgtcatcttcaacaattagaattgttgtattattcattgttctcttcctccaacggtaggcttaattcaaatgttgccccacctaaatcgttattaaaggccttgatttcacccttatgcgcttcaacaattgctttgcatattgctagacctagcccaattccacgtttatgatcaccattatctagactggttgtaaagaaatcgtcaaagatatgattgagctgctttatttcaattcctttaccattatcaattacttgaaaaataatattattatttcgaacaaatgcttttaacatcactttactagcgtcaggagtatgtttaaaagcattatctaataaattaacgagtacttgaacaattaattgagcatcacagggaaacaaaataatatctttggtttctttaacaactaattcatgattttctttacgattagtaattgctgaaactgctgtagatataatatcgtcaactacttctagttttttatttattttaaaatttccttcttgaatccttgtcatgtttaataggttttcaaccatcccatttaaacgcattgcttctttactaatatcttgaataatatttagactagtatcagactcaactgtatccaaattatttactaaaaaattagccccaccagcaatactagttaatggtgttctaagatcatgagaaatacttcttaataaagtactttttaatttttctcgctccacttgtaatctagcttcttctttttcatggcttaaaagatctctttgtaatactaaaatcaactccgcaattattgtttttatataaataagatcttcatcagtaatagttctttgattacaatcaaatttgatcgtaccatacgtataattatcctttttgattggtaaatatacttcctttaaatatgtgaatttcttttgatcctttccacatggttcaccatgacaataacaccaccatgccattaaatcttgaaactctttattttgatatagaaatacttcattttttatttttgttaaattatataaactgtcctgacaataagtccttatttcctcataacccgatagatttaaaaagccactactaatttgatttattttagatgtcacttcttcttgatacaaagcaatttcacgctgtttttttagtcgatttgttaatgtagaaacaattattgcaacaataataaaaataaaaacagatattaaataattaggatcattaatcaaaaaagtatatcgaggatcggtataaagataattgaaagtcataatataaattattgctgaaattattccccaggcaatattacttgtttcaataatacttatcagtactccaacaacataaattaaaagaatgttttcaacccttattttaaaataatctaatattaatgatgaaattgttgctaatatccatataacaatgattttagttaagttaacataattatccttattcttcatattaacctcctagcctgctactcaatgattcaagagaaagtgatttactctttctctctttctactctcaacattcgataaccaacccctacatgagtttgaatatatttaggattagttgtatctgattctattttctttcgtagagttgccataaaaactcgtaaagatgggacatcactttgaattacatcaccccatacttcttttaaaatataattatgagtcaaaactttatcaatattttttgctaataaacacaacaacttatactcgataggggttaagtgtaattcttgatcatttaaataggcacagccagaatcaaaattaacttttaaatccccattagtaaaaacaacatcttcaatttcttgatgttcaagatattttaatcttcgcatcgttgcccgaagccgtgctaataactcatctatactaaaaggttttgtcaaataatcatcagctccagtatccaaagcttctattttactcttatcttcgctccgagcactaataacaatgattggcacaattgaccagctccgcacttttttaataatctcaattccatccatatcgggtaaaccaagatctagtaaaataatattaggacgacgagaaacaatttccaacagtgcctgttggccattttgggctgtaatatatttataatcatgtgtatctaatgttgttgttaccaaacttcgtacagcacgatcatcttctacgactaaaattaatggtttatccatgtatatctacctcctctaatggcaaattaattacaaaaattggtcctcggggataattatcgattactttaatttttccgtcatgagcttcaacgattgatttacataaagccagacccaatcctaacccacgacgactatctccgtttaagttattacgagtataaaacatttcaaaaagtttttctttttgatcatcaggaacgccttctccatcatcactgatttctagtgataatacctgattaagcttcttagttgtaatttttatagttgaacctaacggtgtatattttattgcattatttacaatattaataataacctgcataatcagtcgggcatctatttttacaaaaatgaactcatctgataagtccaattgaataatgtgatctgcactatctttactaatatgatgcatcgcttctaaaacaatttcattaattaattgtgcttccttatttatttgaatattcccattttcaatccttgttattgaaagtaaattctctactaaatcaatcaaccacattgagtcttcgtaaatatcactatatatttctattttacgttcattagatagtttatctgcactatctaataaaactcccgcattgccagaaatgctagtcaatggtgtacgcaaatcatgagaaatagagcgtagtaaatttgcacgtagttcttcttgattcgctttaatttcaacttcacgttttttactatttgaagcttctttttctaaagccatcgctccttcatttaaaatagccattaataaactgttttcaaaatcatcgatcgctgtcttatctaaatagattccaattactcccaaaacactatcttcacaacgaacagctaagtatagacattttgctccgggtaacgtcgttgttgaagcaccagcatgtttattattattaaaaacccaagaagctaccgcttcctcatctttattcaaataaattttttcatcttcctgttcattacttttaaatacgagtggttcacttagttcatgattttcaacaggataaaaaataattgtcttatctagaagtttaaataattgtttagaaatctcatcaattatttctttttttgttttagcccgttgcaatttttgactcgattttaatagaacttctgttcgaaaagcttttattgctgatagacgagcttgttcttttactcgtttagttagagtacctgtgataaaagctgttaaaaacatgattacaaaagttattggataacctttatcatatgctgtaaatgagtgcatcggaatagtaaaaaagaaattaaaagatagcacacttactaaagacgacaaaagagtataaattagattttccgttaataatgaagttgctaaaacacctagaatatgcaccataataatattagcttcaccaaatcctaaatctctaaaccaaattcctaataatgtaacaataagaataattacaattgaaaggatggtatctttaattgataaagaaaaaaattgtcgcggttttaaagacgtatgcttataattgtttctaattttatctgggatgatataaatatcgatcgttggtgttaaagcgattaattgatctgcaaaactattgtgcgaaaaacgtcgtttagtattagttcttcctaatacgatttttgatactccagcaaaccttgcatattcactaatttgttcaggaacattatcaccatacaaatttactatattagcccctaattgagaagccaatttggtattggctcttaatgcctgtttaactttagtcggcattttttcaaaattaggcgtctctacaaaaactgctgtaaattcaccaaagaaagcattagccattcgagcggctgttctaataactttttgatttgaaggagctggtgataaacaaattagaatatgttcattggtataatgatgttcgccgtttttaggtttaatttgctcaaattttttattaacacgatcagctgtacgacggagtgcaatctctcttaaagcaatcaagttatcaagcataaaaaagtttcctaatgctcgttgaacctgatttttctgatatattttcccagcctctaaacgcttaattaaatcttcaggctctatatcaactagttctacctgatcggcattatcaaaaatataatcggggattcgctctttgaccacaactgcagtaattgaagcaataatatcgtttaaactctcaatatgttgaacatttatcgttgtataaacgtcgatgccatgatctagtaattcattaatatcctgatatcgttttaaatgccgacactgctcatcatttgtatgagccagttcatcaaccaatattaaatcgggatttcgttttaatgcaccatccaaatcaaactcattgagcatgattccgttatgagtaacttttaaaggaggtaagacctctaatccgtccaataattttgatgtttccggacgctgatgcggctcaacatagcctgctactacatcgacaccggcatgataagcaacatgagctgcttccaacatggcataagtctttccaacacccgctgcgtagccaaaaaatatttttaatttaccgcgctgtttagcaatctcttcttgtttaatctgttttaacaattcttcgggatctggtcttcgttcatccattacacttcctcctttactgttatttttattatagcgcctaggatattaaaaaagtattaagattgctttgttaaaataagtgcctatcataatgacagacacttatttttatttcaaaatgccatcaagagccaaattgactttaaggacatttactgttgtttctccaaaataaccaagaaatccatgatcagtatatttatcaataatctttctaatttcagcttcactctttcctgttgttcttactaaacgtggaatctgatattccgcagctgctagagaaatatgtggatcaagtccagaaccagatacagttactagatcaacaggtatttgtttacctttctgctccggatttgcagcctcaatcattgcaaccctttcagcaataaccttttcataatcttcactagcaggagaactgttagatgctagaccatacattgtcttttcaccatctttatttgtgaaagtttcaccatcaattatcatgattctaccccacatatgagtatcatcgataaattgttgacctaataattcactaccatatttttttccatctacttcaataatgcttccatttgctttgtcaggaaaaacaatttgagcaaaaccagtaatagcagcagtataaataactccacaaacaactgtaaagatcagaaatatttttaaagcgggtagaacgcttgttttaagatgtttcattaaacttctcctcctacgatacaatatgcaaagcaacaataattacatcaataattttaatacaaataaagggagcaataattccacctaatccatatattaataaatttcttgataataacttaccagctgacacttcacgatattttactccttttaaagctaacggaatcaacgcaataataattaatgcattatagatgattgctgagaaaatcgcactatctttactgtgtaatcccataatattcaaagcatctaatcccggatataaagtaatgaatagtacaggtataattgcaaagtatttagctacgtcgttagcaattgaaaaagttgttaaacttcctcttgtcattaataattgtttcccaatacgaacaatatcaatcaatttagttggtgaagaatctaagtcaaccatatttccagcttctttagctgcctgagtacctgtattcattgctactgcaacatctgcttgagccaaagctggagcatcattagttccatcaccagtcattgcaacgagatgtcctttagcttgaagttctcgaatcatttctaatttgccttctggcgtagcttcagctaaaaaatcatcaactccagcttcagctgcaattgcagctgctgttaaaggattatcaccggttatcataaccgttttaattcccattttacgaagatcagcaaacttttctttaaccccttgtttaataatatctttaagatgaattactcctaaaacctttttatttttagttacaactaatggtgttcctccaagattagcaatctcagtaactaccttttcacactcatcactatatatatgtccgttttctgttacatattttttaattgtatcagctgcacctttacgaatttcattaccttgataattaacaccactcattctcgtttttgcactgaatggtacaaattccatatgcatttgattaatacttcgtccccgaagattaaattgttcttttgcaagaacaacaatactacgtccttcaggagtttcgtcagctaatgaagccaattgagcagcatcagccaactcttcgctcgttaccccatctacgggaataaatgcactagcttgacgattacccagtgtgattgttcctgttttatcaagtaataaggtatcaacatcaccggctgcttcaattgcccgaccactcatggcgagtacattagcttgatttaatcgagacattccagctatcccaattgctgataacagtgctccgattgttgttggtgctaaacatactagtaaagctactaatactgtcaccgaagaaggattatccatccctgcttgtttagctccaaaagctgaatacgcgtaaagtgccatagttactaaaacaaagataattgaaagggctacaaggaaaatttgtaaggccatttcgtttggtgttttttttcggttggcaccttcaaccatggaaatcatcttatctaagaaactttctccaggttcacttgaaatttgaacaacgatccaatctgataaaactgtagtcccaccggttactgcacttcgatcaccaccgctttcacggataaccggtgctgactctccagttattgcactttcatcaactgaagctacaccatcaataacttcaccatcaccaggaatttgttgtcctgctttaacaagtacgatatcaccttttgttagcgttgctgatgatacaatttcaactatatctttttgatcaatgcttggaatcttataagcttcaacatctttcttagctgctcgcaatgaatctgcctgcgcttttccgcgtccttcagcaatcgcttctgcaaaattagcaaacagcactgtaaaccataaaattactgctattcctagagtaaatccagaatttgcatctttaatcccaaataacgaaataacaaacaaagccgtcgttaaaatagctgaaatatatactaataacattacgggattctttgcttgcgtcttaggcgctaatttataaaaagaatctttaatagcacgaatgaccatttgtttatccattaaagcactctttgtttctgttttcatatatttatcccccgattaaaacattccaaaaaattctgcaattggtcctagagctaaagccggaaagaaacttagtgctccaactaataacactacgaatactaataaaaagacaaatagtggtgaacaagttgataatgtacccgcagtaacagccacttttttcttttgtaccatgctgccagcaatagccaaaatacctaaaattggaataaatctaacaaataacataaccaatccaagtgttacgttaataaatggtgtattcgctgcaaaaccagcaaaagctgaaccattattaccacctgctgaagaataagcatataacaattctgaaaaaccgtgtgcaccgctgttatttaaactatccgcaacttgaggaactagggaagcaatcccactacctacaagaatagctacaggtgttgctaaacaaacaactacggcccatttcatctcataaggctcaatcttcttacctaaatattctggggttcgtccaaccattaatccagccataaatacagctaaaataacaaatcctaacattccatataaaccacagccaacaccaccaaaaattacttcacctaactgcattaataacattgttaccattccgcctaatggtgtataactatcatgcattgaattgactgaaccatttgatgctgctgttgtaaaagcggcccaagttgatgatccaacaattccaaaacgcgattctttaccttccatatttccgccagcttggtcatggttactaatatcgacaattccattttgttctaattgtggagttgccatctgctcactaacagcaatacttccaagtgctgctaccagcataattcccattgcgacaaagatagcaataccttgacgactatctttaattcccttgccaaatgaaaaacaaagagccgcaggaatcaataatattgatacaacttctactaaattacttaatccagttggattttccaatggatgggctgagttaacgccatagaaaccaccaccattagtacctaattgcttgattgcaatctgactggccgcaggtcctaaaggtactgtctgttctgtaatttcagtaccatcttctaaaacaattggttcggccaatttaacagtttgatactcatcaatactttgagttacaccttgactcactaaaataattgataagacaactgatagcggcattaagacatagattacagatcttgttaaatcaacccaaaaatttcctaagcctttagccttaattcttgtaaagcctctaatcaatgcatataaaactgctagtcctgttcctgcagaaacaaagttttgaaccgttaaacctaacgattgtgttaaataacttaatccactttcaccactataagcttgccagttagtgttagtaacaaaacttattgctgtatttaacgcaaggtcccatgttgttccttcaacctttgcaggattacccggcaaaactccttgcagcatttgtaataaaaagacaaatactaatccaaatccactaaatattaatacacttactaaatacttcttccaagacatctcttcatctttttttacatgtaaaactcgataaatgaaattttcacatggttctaaaattcttgataaaaaaacttttttaccgttcatgactttattaatgtaaaaacctaacggtactgctaaaacaacaagaacgattagatatcctagatatttgacaaaaatatccattactgtttatcccccttaattaatatcactgtaaggtaacctaatattgcaacaccgattaccccaatcactcctacgattacattcataagtgtcctccttttacacgatgagtttagcatgaataaaattaatgtagcgttaagttaaatattaaagatattaagatagtattaatatctattaaaaagagaactaattaagttctctaatattgccgtgataaaaattgaatcattcccatacttcgaggatgctcaaatatttgctctggtgttcctgcttcttcaataattccattatgcataaatataactttattcgaaacatcacgcgcaaactgcatttcatgagtcacaataatcatagtcataccttttaacgctaaatgtttaatgatttttaagatatctcctaccatctgaggatctagtgcacttgttggttcatcaaataaaagtacctgtggttccatacataaagctcttgcaattgcaacccgctgtttttggcccccagaaagttgtgtactgctctttttcgcaaactcagccataccaactttttgtagatataataaagctttttcttcagcttcttcacgattgcgatttagtactttcatttgccctataacacaattttctaaaactgtaagattattaaataaattaaagctttgaaaaatcattccaacatcactacgatatttattaagattaagttcttcttttaaaatatttttattacaatacaatatctcaccatgatcaggaatctctaataaattaagacatcttaaaaaagttgatttaccactaccacttgctccaatgatactaattacatcgcctcgattaacctctaaattaatatctagaagtaccggcagggcttgataatgtttttttaaatgtttaatagtaataatattatcactcataaataatttcctcactttatcttaatattggattatttattcttttttcaattatatttaataaaattgtcgcaattgaggttaagcacaaataaaccaggcatgttattaagaaggtcgctgaatatgacattgttgatccagcaatactgctagattggaaaaataattctacaaccccaatcacattcagcattgaactatctttaatattaataatgaattgattcccaattgcgggaaatgaatttctaattgcttgcggtaatataatatacttcatagtttgaacccttgtcattcctaatgataacgctccttcactttgcccacgatcaacagattgaattcctgaacgaactatttctgccatgtatgctccagtattaatagaaatgatcataattccggcagtaagtgcattccattgaaaaaaaggtcgcaatccatgataaaaaaacatagcttgaaccagcattggagttcctctaaaaaaccaaatataaatttctgaaattatttttaatgctttttttattagtacaataatctttttatctttaatatctatcgttgttgcacgaattgctccaaatagcagtccaattattaaacccgctattgttccaactaatgccaaaataattgttattttcgttccataccaaaataaatcaaagttatctaaaaaaatcgtaaatgatttatcaaaatcaaacatgattattctcctttaggctgactactactatatttacccatcatttcatttcttttttctgatgaaatattatcaatgcatttttgtacttttttaaataaagtactgtttcgactaccctcttttaaacctattgaaactgcggtatctactttaaaccctttattttgttcaaatctaacaatcgctagatcttgatttgtttctaaaattccttgggccacaggtaattccgcagtaattccatcgacttcaccactttgtaaagcaaccagcatttcaggataagattgtttaggtgtagcatgatcaactccattaatttgatcaattactgtatcataacttgttgacatctgtcctacgatcgttttaccagaaaattgttgaatatcagtataatttttactagcatcatcaccccgtacaatcataaccatttcagattgataatatggtgttgtaaaatctattcctttttcacgctcttcatcagctgtcattcctgcaataatggcatctatttcgcctgattcaagtgcaggttgcaaaccattccatgctaatttttttataaccagttttttatcaagactttctgctatttcctttgcgatataaacatcatagccatcagcgtaaccactgccttctaattcaactgcggtatcactttgtgtatttgtctgccagttaaacggtggataattacattccattccaactacaaatacatcaccttcatcaatactcttattcccactattactctcacagccactaattaataaagctattaataaaaaagctaatattttcttcattttatcgtttattcctttctttttaatattaaatattgaaataagttaaaccattattttatcctcctctagctattaaaagtctagcatgctaataattaatataggattaaagagttgttttaaaatattaaaaagacataaataaagaacaaattaaattctttctaattaacatttattaatgaacatatgcttttttagtagaataatgtattattgatgatttatttaaatatgtagccaactcctttattttctcagtggctttttacaacgacaaaaaagaattggatttcaaaaccaattcttttttataatattaattttattatagattaatcctctgctaaaactttatcctttttcattaaaatcgttattagaacaattgtactaattaaagaaattattgtaatcgcaatgttgctggcatcacccgtatttacagaatgatttttgttatttgtatttgtgttagaactattatttgtttcttcaaccgttggttcttgtgatggattatcagttttatcatcgcctgattgatcactatttttttgcaaagtcagatcgtaaactcccactgtcccagatacttcataagcaacaactaattgtggtttccctgtaatactatcattacctgcaataaaatgaattccttcaggtgaatcatcaccaccaatatctgtgctaaaatcacgagaattaatataattaacaaattctgttttttctggattcgtaatgtcataaaccattataccgccaattctctctaatccaataaaagcaaatgttttatcttcgatttgaccaattgtcacagcttctgcttcaggaccttttttaccagaacgatcatctattgtagcatcatcattagaacagttaaaattatttggcaaatatgctgcagttttgacttcaaaatcatttcctgttgtataaatttcttgtaatgactgctcatcagctttaaaaattgttgatgatcttcccccaaacaaataatcattttcattattaagaccatcataatcactagtatcgaagaacgtgaccttaccagttaaaccactgttatcagccgttattttaccagttggtgaagtttttcctttaccaaaatttacctctatttcatttgaataaccattccagtcacgactatctccttcattagcagttattaaataatcgattccatcaaccgtgtaaacagaaatagcatcaggcatccgaattccttttaaagaatcatatgtttgtgcattatatttttcatcttttttatcaatatcaattgcaattttactataatcttcaaatcctactgaataaatatcttctatttcaagactatttaaatctaatttagcaatcgcattagcttcttgtaatgtaatatatgctttagaatcactaactgcaatatattctggttctaaatctgttgatggcaaaacgccttttttcaaaacaattcctttttctattaatgcatctcgttgactatcaaaagctgtgaagtcaacagtttttgctttgtttgttttggtattaataacgcttatactaccttttggatcaactgctccagtatacccgtcccgaggttctccttcgttagctgttaaaatttgtccatcatcattagtaaagacaaccatatctggttgaacacctacttcgaacaattgctttaaagttattgttccatcttgattacaatcaaataaagctactctaccattagcattagtctccttaccttgaatcgcaacagccaatgaggttccatcatgactaactgctactgatgtcatatcaccatatgtaaaatcagcactttgtactaacgaactaatatcaatgtcattaccgtccaataagtctattttatccttattttcgatattttttagggcaattgctgttaaatttccagattgtccattaacagcataagcccatcctgtcactgtgttataatcaactatttcagttactcccccatcactgttagttgttcctgaatcataacgagctgactgttctagcgctaataatgctgaattgttttcataaccagttgttttttcaccaccgtcactatttttagtaacagtaaacgcatcgatttctttactatcaggattagtttgatcaccagcaagattataaacctttaccgatattcgattattttcaacattaaatactgcataactaggactatactcttgattccattcttgatttccaactggtaatgaatctccttctaggtaagccgcagagccacttttaccattagctaagattggataatcagcattattatttttatctaatgtttcaaacggtgtataatattgcatatctgaacaacagttccccgtaatataaattgttccttgaggattattaagtgtatctaatctttcactatttctttgcccatcttttaaaacatagctacgtgaataaacatgatcatgtccgcctaagacaaaatccacattatactcatccataagtttttcaaatcctgcatcaacatagttttcaatatcactatctgctgcatgtttagcaactgtttgagtagatttatgatgagtgactataatccattgatattgattttggtattcactagttgcactctttaatgtttgagcaaaattattgatgattgcttctgcctctgaattatctctagaggcacttgaaacattaggattgtttgcattttcttcgtcatttcccccaggataagcactagtatttaaagtgacaaataaaacattattatataaatagtaataatttccttgagtttccatatcacggcgttcactaaaatcatattgaccatcactatttggtgtcaccccattagaagctgcattatttttaatttcattttcagtagcctgaatataatttccgtgactttgactagttccactattttgtcctctaaacgttgttttaacttcagttaatgattccatttgatttggtaaattaaaatgatctgcgaacatatagtgtctatcatgatttccaacagctggagcatatggaattgatgtcatttcttctggtgcaaaaaaagcctcatactcgcttgattttccccagttttgatcttcaacttgatcccctgctgacactactaagtcaacaccttgtttttctaaagtttccatcatagttgcccaaccggtttgatttgtttcatcacttgggttccaaccttcagaattaatttccttgttttcctttatttgtggatcgcttgtaaaaccaaaagtaaattcattgcttgatggagttgtataattatattcctttgaccaagttgttcccccatcatttgaaatataataagtatacttagtatctggttttaaattactaattgtcgttttacatactaattttccagtatcagtatatttatcactttttatttcggttggcgaagtcaatggtttggctgttacatcataagtttgatcaccaaactgaatttttgctaccgtcgttcctgctggtgcataccaatttagattgattgatgttgttgttgcccctggctgaagtgttaaactatccacactaaatgaaccagtatggctttcacctgcaacctcactataagtatcttgggcataacctttagtcaaaatgttattttgaccaatcaacattgtcgataatgttactaaacacaggacccctttaataattcgattatttacttttttcatatacttttcccctaattacatatttgtacgtagtgtactaagtaaatttatcatagccgtcaatttctaactatttctattttgtaaattttaaaataagattttgtaaataaaaaactatttccagttagaaatagtctacctttgttttcatagcatcattgctacaaaaatttgaattattcccataatagcaagactaaaaccaattgttctattaagtatcattattagagtactaatcatgatcaatattttcctaataattattgatactttggtcttttacaggggtccttctttattcaaataaattaattgaatcaatttttttattgtttttgatattttttttcaatttttgatttataaacatcttaattatgctttctcgtatagccaaccataataataattgttccgacaatcatatttaaagctaaattcataatcatcgaaaataaattgacaccagatatgtagttggcaggaatattagtaatatttgataaacagatacataaaccaatcttataccaaatattcagcgttgtttttacccatatccatatgactatatatacatacaaattagtaaacaaagcaataaccaaagcttcatgtaaaaaccagtctaatgaatacacctgaactgaaactacataaagcagtggaattacccctatactggctacaataatagctttaataacaacattttctttagcttgaactaaaaccgttaaaattatccaagcataaataattgctgcactacttattattgaccacgtgaaactatgatttaggtaataattacataaacatggtacaaagattccaatcatcattacgattgtgataaaaagataactgatcttaatgattctctccttgttttcaattgcttttatctttgtataattgattagattttgaactgtctttttctcacttttatcaactacagtaccaccaatcaattcatcaatactcatctttaaagcctcacttaacggtaataataatgagatatcgggacacccgattccacgttcccattttgatacagctttatcacttacattgattaaatttcctaattgtttttgagtatacccaagatttttacgagctgataaaattcgtatcccaatttctttattatccataaaattacttcccttctacgtcctaatcctaacataaaagttataattttactatcgacggactgtttacctcactagaatccttgatctataaaaaaagttgtagtcaacctacaacttattgaaaatattccttacatagtcaataggatattgtgtaattctacttacttcatctatatcttttttagccaataatagatttgtaattactacatccattgcttcaccaatttcaatcatatgattatcgggatcaaagattcgtactacccgctgttgccaattatattttttgattgggtgaacatatttaatatttggctatgtctccaacttttttataaatttatcaaaatcatcaacttcaaaatataattccatattacaagctttatcacaaacccaatcactagggacatcaacgagccaggcaaaatctttttgtaaagcaaaaccaccatcaaaagtaatatttaaaccatgatctaaaattattttttgatcgaacaattgcatatagaactgtttagaaacttcgagatttttgactgctaagacagttgcttctaatttcatttgattttaccccaacatctgcattgttctaaacgttttccctgatccccttgtttttcgtcataagcatacgatttagccaatttgcatggaaaatcttcacattcaccacaatgatttaattcttttgtttctacgcacgatttaaccggacaaatttcaccccaaaaaggatgttcgatattaatacatccagcacacccaatcttgcttttaaactcacattcactacatataattccacatctcgattcaatcattttcatcaccatcctaagcaaattataacttagaacttatatatttcattgtaaaaatccgccaagttcgataaatatttcttaggagttgtttttgtaatctgcttaaacactttgttaaaatgagcctgatcaaaatagcccccttgcaatgctaaagataaaaaatcatcttcttctatttgctttaataaataattaaatcttactaccttagcatattccttaccactcaagcctatgtaattatgaaaatcacgtaataattgtcgtgaagaaaggtgacaatcactagctaccttttctaaactaacatttccgtgatcctgatcaataatttctttagctctaatcaaacgagctggtaataaattaacttttctttttcccgtaaaatatttattaaaagctttgatcaactgttcataatctttacatgattgataaagtaatgctaactcttcatcaagctgcacatctaaatatctcaattgctgacgctgatttacaagttttttttgatgtaaaccactaatttgatacaatcctcctggtctaaattctacaaagaaacgagctggggctttttgcaaatcattttctaaaaccacgatttcactcattggaccccaaaaatctcttcgagagcgtccctgaaaaataaaacagccactagcatcaggaataatatgaaataattttgatgaggcgggaacttcactaggaaaagtaattgtataatgagcaataatatcttttaattcttcactaggagcaatataaatatgatgatctgttttattaatataacttcccttataatcgaaattcttcattaaattacctctttatattaaattacctgcattattttatatactcagtataatattggcaggacatttaatcaaatcttaacaatcttcattggctataaatatttacattcaatcatgaatttgatagaataattctcataaaatttaattacataaaaaaggagtgttttaatttatggatgcaggccccgagtcttcaatcacattgcaattaattttaatcgttgttcttaccttaatcaatgcatattttgcggctagcgaaatggcaattgtttcggtaaacaaaaacaagattcgtcgtttaagcgaggaaggaaataagaaagctaagttagtagaaaaactattagatcagccaactaacttcttatcaacgatccaagtagcgattactttagcaggtttctttaactcagctagtgctgctacgggtatttctgttagtttagctaatcttttaaaagtttggtcaattccttacgctgatacaatcgcagttgtcttgattactattttaatttcttttattactttaatctttggggaattagttccaaaaagaatcgctttacaaaaagcggaatggtattcaatgttctgtgctaagcctattttgatcatcagtaaaattgctggaccatttattaaaattttatcttggtcaactaagtttgtcttaagattatttggaatggatgatgaaaatgttgaagaatctttgtcacgggaagaaattcgttcaatggttgaaagtggacaagagacaggagttttcaatgaaattgaaactgacatgattaccaatatttttgaatttgatgatagtttagctttaaacgtcatgaccccaagaactgatgtttattgtattgatattaatgacccattaagtgagaacattgatcaaatgatgtcaatgcagtatactcgaattcctgtttatgatgattcaattgataatatcattgggattttaaatatgaaggattttgctattgaagctagacaagttggttttgacaatgttgatattcgtaagctattacgaaaaccatactttgtcttagagactaaaaatattgatgatttatttaaagaactacaagaagatcgccaacatattgcaattcttgtagatgaatatggtgggttttcagggatcgtcacagttgaagatctaatcgaagaaatcatgggagatatcgaagatgagtatgatcatgacgatgaacctaaactacaaaaaatagatgactataattttatcgttgatggaaattatctaattgacgatcttgatgatgaattagatttaaaattagataatgttaatcatgatacaatcagtggttttgttcttcatttattaggagaaattcctgatgataatcaagaacgtagtgtaacttatgaaaatcttacatttaaaattactggtgtaaaaggtaatcgtgtaacaaaaatcaaattaacaattaaaaaatcagaagaaaaagaatccgattctagtgaagactaaaatcggattttctttttaaaataatagtaattatagaagtaatcaattctgttaccacataagttagccaaactccatctactttaaaaatagttgataaaataaatattactggtgcaattaaaataaaacctcgtaatgatgaaattataaaagcttgacgtggtttatcgcttgcactaaagaaagtggcactaatcatatttactcctgcaaaaataaagcccccaaaataaatatgaattcctctaactgccaaatccagcaattccggattgctacttgaattaaacaaagctacgatctgagcagcagcaaaataactgctaagataaacaataactgcaaatataataactgtccaaagaccataatgataagctaaatttacatttcgatattctttaaaactaagatttttactaataattggttgaattccctgagcaacacctgtaaacatcgatacaataacaaaagcgatattagcaataattccgtaggctgcaacacctatattcccgctatacttcaacaaagtaaaattaaataacaacattactattccagtagctaattctcctattaaagctgataatcctaataaaaaaatatctttacaatggttaagacataattttgttttaagaaatttaaaattagctttcttgattacatatggagacataattgaaattgaaataaccggtgctacccctgttgctaaagcagccccaaacattcctaaaccaaaagggaaaataaatatataatccaaaacaacattagttaaactaccaattaacattcccatcattgctaatctcggattatcatcattacgaacaaagccaatcaataaattattcaacataaacattggtgcaaaaaacataattgtttttaaataagttgcagtatagatagttgtatcttgattagcccctaaaagatttgctaatgatgtcgacgcacttagtcccaaaacaacaaaaataatggctagaataagcataaaataaagagcattactgaaaattatattttgtgaggttctattactatttacctttaacaaagaataccgtgttcccccaccgattccaatcattagtcctaagccatttattaaacagtacattggtaaagctaaatttagagctgataatccaatttcaccaacaccatttgcaataaaaaaagtatctgccagaatatagcatgataaaccaatcattcctaaaacatttaacgatgtatattttaagaaatctttaaaaatataatttttcatcctcattcctccagtctttctccatcttaaactataagattaccttatagtcaatcaaattttaaaaatatttcaactaaagcgactagattaatcacttttttatttatcaagttgtaacttttaaataaactagcctaaaacactaatcttcattttattagccaataattttgattattatttaattagttatcagttattactgaaaggggaggtgaaaatggaagatttcctaaaagatgtatatacatcgatatataaaaagtggattttatttcaacagatcgataattgtcaaattatgctttcatcaaaagatcaaaataaaattatcttggagacaaagtatggtgtagctaatgttattttttataaattcaatattattgaattaaatgttattagtaaaatagatcaagaatcttgtttctttttacactttcaaatgaataacataaatcatgcaattaatctattttatgaaatggttgaatgtttaaaaacattgatcaagaaaccaaaaataaaaatcttattatgctgcagtggtggtcttacaacaacttattttgcttataagattgatgaagcaattcagttatttgctcttgattatgaaattgcagcaactggctacaacgaattattcaaaaaaggtgaacaatatgatgtaatcctactagcacctcaagtttcttttatgtatgcaaaagttaaaaagatttttaaagataaatatttacttaatattcctgcacaagtatttgctaaatatgatgtaaaagaaattcttaatctagttgaccaagaactaattaaaaaacgtaacaaaaatggtcaagttcaattgctttcgattagaaataaaaccatcacctttcatcgtaaaattctatgtatttctctttttagaaatcgtaatcggattcatattgcatatcgactttatcaaagtcaaagtgatattattgtaaacaatgaaacaattaaacaacgaattacaattcaagacatctatgatgttatcgatactgttttattaaattatccaggtattgaggttattggtttttcaacaccaggaattgttaataatggatttgctacaactgccagtattaatggttttgatgatatgaattataaaaaattgtttacaagcaaatattcacaaaaatttattattacaaacgatgttaataccgcagcaattggctatcatgctactcaaaatcaatactcatcaattgtgttactttttcagccaatgagtactaaagctggtgctggtatcatcattgataataaattaatcaatggcaagcataacgtggcaggtgaaatgaaatacctccccgtaaatctattagagaaaggtgctaatgtatataaaacaccagaagatattattaaaattgttaaatatatttctttatcgattattagtgtaattgggcctgaggcaatcgttatcttttgtagtcttttacctaatattgaagatttagaaaatgagttaaaaacagtattaccacaagaatatattcctcggttaattaaaattgacgatattcaagaatatattttcctaggtcaaacaattatttgtacctaaattaaataaaaattaaggagaaaattatgaaaaagattttattagtatgttgtgcaggaatgtctacaagtttattagtaaaccggatgcgagaagttgctaaaacaaaagaaattgattgcaagatctggtcaacaagtgaaaaagaattaccaaatgaatttgcccaagaacctgctgatgtaattcttgttggtccacaaatcagatatttacttaataatattaaaaaagaagtaaacaatactgttccagttgagcttattgatatgcgtatttacggtatgatggatggtgaaaaggttcttaatcaagctttaaacgcattagaaaaataatcaactgacagctattttaaatagtgcatataattagataattcaagacgatagagcaatgttgcatataaaatattgattacgtattcagcactaaaagtagcacataagctatcaatatcttcaaataaactagtatcaaataatagataatcgtggcacagctgaattagatccttaccctttttacctaatatcccgaccgtatatacattcctattttttaaaattttagcaatttctttaattaagttattatcgccggtcgtagtgataaggatcgagacgttactttgatgctgctgcatattatcaatatatttaatattaataccattttgatatgaacaaggaagccctaatgattgtaatttaaaacacatttctttagcaatcgtatctgaaagaccaattccataaatatcgataaacgaagcactcaatatccgattacaaacacgattaacaacatttttatctagtaatcgatttgtctgaatcatcgctttttcatataaagaggcaattactttttcagtatcttctaaagatgtaaaatactgttcaggatgctcagttgggagatcattatatttaagataatcatttctttctaagatcaatgtagataaaaattcacgaaaattattgaaccctaatttcttataaagacgggttactgccgcttgtgaagtataactctgttttcccaactcactgcttgtaagattattaattttttgatctttgtttaaaagaaattgagcaatacttttttcagtattggtaaggttattatcatctaataagtgttctataatcatatttcgtagacctcctttaactatttgatcgtatctatattttatcaaataatcaataaaataaaagggttgaataaatcaacccagtaattgtctattaatcgcataaacattgccaattatcatcaaaatgtgctttgaagcacatttttatctgttctaaagttactttctcctcagctaattcaggaagttcatctaggctaaaataaccactatcaagtgtttcaatatttggtttaaatgcaccaccaagataagaacattctatgaaaatcttagtaattccatacgcatagcgaggcgtattatgaatattacgatctagaattgcaattactttaactatctgagcctcaatcccggcttcttcttgtaattccctaattgtattttccttaacacttgctaaagcatctacccaaccaccgggaattgaccagcgtccatcagattcctgcaccagcaaaatcttatcacctttaaaaacagcaccacgagaatctaattttggtgtttgaaaccctgtttcattacaaaataatgaagtaactgttgcaatcggtaaatcactttgtaaagcgaccatttctgcagatatttgacgaattcgctcaaatctttcttgatcaaatttatcttttgtatatgctaatccaccttgagctaaaaattgtaactcttgagctaaatctaaccacctattttgtttgttcatcatttttttctctagtttcattaattacaactcgatgcggatatggaatatcaatcccgttttcatcaaaacgtttcttaataatcaaacgcaaatctgataataattgaaaaccagcaccactatccttagataataatgttgctcgtaattgaattccactatcattaaattcgacacaatgaactttaaccattggttcatgttttttcttttgtgctttagttctgccatctaaacataatgaatgtttacttccttcttcttgaataatttcaattgctttttgaatatcactttcgtaagaaacctcaagatataaatagttggctttttgagtcttaacattagatacattttcaataattgctttattcattatcgtattaggtataattacctgtgttctttctaatgtttcaatgacactgtggcgcattgaaatatcaattacagttccaataacattatattctctaacattgacaaaatcaccaattttataaggcttataagtcatgatcataaaaccattgatcatattacttgcagcttcttgtgatgctaacccaactacaactgctaagattcccccactggccagcagagccttaatgattgactgcatcgccgtaatttcactcataataattgctaaaacaattgttactaaaacgatttttttaatacgcattggaaaaactaatttcaacggatcatttatcttcttttttataattttattgattattttattaataaccaaaactataacaactgatatcaaaatacttattccgctatcaattaatccatgttcaaataaactatttattcgttcataagttttatccatttaaccacctacttagattttgaaccataatatttaccaataaaatatagacagacacattgaatagctccaattattgataacatcaataaaacatagctaatccaaaataatatatcattacctgtattaaaagcattaattattagaaatactacaaacgatatagctgccacaatccctaaatactttgaaaagcctagaaatctagccgataaaattctatttttgtccattttatttacctatacaaaagcgtttaaataattcatctaataaatcttctttcgctttctctcctaatatttcttttaaattattccaacattcatataaatcagtaacaatcaaatccgttggtaccatcatttccatagcttcaacagcttgttttaaagcctgactagcacgttgtaataacattgtttgacgtgcatttgtcagaatatgatcattattatcaataatcttacctaactcaaacatttttttgatttcttctgtcaaagtgctaatttgattatctttagcactaataacaataccatctaaatctacttttgttccttgatcggctttattaagcacgataattctagtagcatcttctgttagttctaataactgcatatcttcactacttaatgactgcgaaccatcaattaccaataaaacaaggtccgcttggtgaatcagttctttagacttttcaacccccatactttcaatgatatcatcagtttctcggattcctgcagtatcaatcatattgagaactactccatcaatgctaatacttccttcaacaatatcccgggttgttcctgcaatatttgttacaattgctttatcctctcgaagcagagcattcaataaactactcttaccaacattaggacgtccaataataactgttttaattccctctttaactaatttaatatttttagaatcatcaagaatcttattcattttagtcaatagattggcacttcgtggtaataacgaagaagcagtcaattcctcaacatcatcatattcaggataatcaatattaacttcgatctgagtgattatttgaattaaatcttctttcaaatcttcaataaaaccgctaatactaccactaattccttttaacgctaaatctgttgcataactatttttagcagtaataatatcactaattgcctcagcctgtgataaatcaattcgaccattaagaaatgctcttttactaaactcaccacgctcagccattctagcaccatttttgatacacacttctaatactcgtgaagtaatataaacaccaccatgacaatttatttccaccatttcttcacctgtaaatgttcttgtacctcgataaatattaactaacacttcatcaattctttttccatcgtcaatgatatatccataattgatcgtatgactaggtttttctattattttgcctgtaaagaatttttgaacaaaggcaatacaatctggaccacttactctaatcattgaaattgcagcttctaagcgacttgttgcaattgcaacaataatatcttcgttcaaaatatcaccttcctttatcttttgtattttatcataaattattattaattaatatacctaatcaatgctataatggtggtaagcagggaggaattcaacatgaaacttggaattatcggtagcggaatgatcgtctacgatttattaacattcattgatattattgatgaaatagaactaacggcaatattagggagaaaagaatctcaagaaaaaattgaaacacttataaataaacatcatataaaaaaagcatactatgattatgatgaattgttaaatgatgatgaaatagatactatttatgtagctttaccaaatcatctccattacgaatatacaaaaaaagccttattgcataataaacatgttatttgtgaaaaaccatttacttcaaatgtcaatgaattagatgaattaattgctttagctaaacaacaaaattgtcttttatttgaagcaattacaaaccagtatcttccaacttttaaagaaataaaagaaaaaatatctgagattgggaaaatcagtattatttcatctaattattcccaatattcttcacgttataacgcttttaaacgtggtgaaatattaccagcatttgatgtcaataaatctggtggggctttaatggacttaaatgtatataatattcattttgttgttggtttatttggtgcccctaataaagtagaatattttgctaatattgaaaaaggaattgatacttcaggagttgctatcttggaatatccaacatttaaagcaatctgtattggtgctaaagattgtggtgctccaatcatttctacaattcaaggtgatcaaggttgtgtaaaaattgatggtcctaccagtgttctaactgatgtgcaaattttaagaaatggccgagatagtgagattctaccaactggtaactatcatcgaatgtatagcgaatttaaagtttttgcggaatgtattgataataatgactttactacatgtaataaaatgcttgaacattcacgaatcgtcatggatgttttgactaaagcacgccaaagtgcaaatattatttttggttgcgaacgggatacaaaataatctgtatccttttttattatcaagacatagtaacaatgctataataatatatatacattacaaattggaagagggtggctaaatgcagaagatatttaggaaatacattatcataatcatgtctatttcattagcctctgttcttttaataaattttttcttatcaactgattctttacaagcccgaactttagaaacatttaatttaaaaattaatcaagtaattcaaacaattgaaaataatcgtaccgaattagtatctttgaaatctagtcttgatgaagattatttaactagagcaaaagcatttgcttatgttattgaaaaaaatcctaatatcattgaaagtgtcactgaacttcaaaatttagctacactacttgatgtagatgaattacatgtaagtgatagtgagggtttaattgcttactcatcagttcctaaatatgttggtttggattttcataatggtgaacaaatgcgtggttttttaccaattttagaaagcgatgaccctgatgaatatgttattcaagatgctcagcctaatactgctgaaggtaaaattatgaaatatgttggagtggctcgtaaagacaaaaaaggattagtacaagtcggtcttgaaccaacacgacttttagaagcacaacaaaggaatacatattcctatatattttctagatttcccacaaatgaaggtgagcagctttttgcaatcaataaaacaaccaacgaattgattgccagcactaatgatttaaacgacaaagaagcaagttactatacttatgataatttaaaagattgtcaatctggtacttttaaagatattggaaacaaaactgaaaatttttttgtaactagagaatatgataatattttaattggagcaactgttccaaaagatattttatataaaaatcgttcaagtgatttattattaattggtgcttatttaattgcaatcgaaatcgttatcgttgtgtcaatcaatgttatattaaacaaaaaagtattaaaaggaattcatagtgtcctcaatgatttaaatagaataaaaaatggcgatttaaatactgtcgtaaaagctgatgataatcaagaattgatagatttaagctctggaatcaacagtatggttaatagtgttgtcaactccgctgatcgaatatcaaaaattatctccattatcgatatcccactagcagcatttgaatatcaaaatgatacgaaacaactttttgccactgcaagattgaaagaactgctccatttaagtgatgaagaagcaaatcaaatgtatcttgatccaaaacaactattaaaaaaactacaaataattattagcaatccaattgaaggtgagagtgatgtttattgtcttgaaaaagatacttttataaaaatccgacttgtgaaagatgaaaatggtttctatggaactgttaatgatgtttcttctgatattttaaagaaaaaacaaattcagtacgaaaaagatcatgatcatttaactggactattactatacccatcattcaaaagagaagtaactttagtcattaataacaataattataatcatttatatgcagctgtaatggttgatttagattcatttaaacatataaatgatacttatggtcatgattttggtgatcattatttgaaacgtttgacctacgcattaaataagctttctaaatcaaattgtttaatcgcacgacgatctggtgatgaattttgtctctttatttataattatcaagataaaaatactataataaatcaattaaataaattatggtcttattttaaagaagaattaattgaacttcctgatcattcatatcaatcaataaaagtatctggaggctttgtatgtagcagtggtccaaataatactatcgaagaattaatgaagaaatctgataaagctctgtatgaagcaaaaaaccactataaaggtcattttattgaatataaaggaaaatagttgatagtaaatcataaccacgcctaaaagacgtggtatgcacccgccctgtaagggcatgctgttgcgctagtcattcgaccacgaatgtgaaatagatgatctgtatgtagcaggtgatggagccggattaacaagagggctggctcaggcaggagcaaacggaatcatcgtagcacgtcatattattgaacatcttaaatagtaaggtaaaaatcctgttttagacaggatttttctattttgacaggtgtagtatcatggtggtaaacttaataataagaccatagggaaggagaaacttaaatgaatgtttttgttacttcattattaaaaataattaataatccggatattcaagatactaattataatattgcttattatttattactgcactattatgatgtttttgaaatgacacttcaggaaattgcagatgcatgttatgtttctgtttctactctcaatcgcttttttagaatatttggatttaaaaaattttcaattattaaagatttaatgcaagtccatgcggcggcacgaataagtcagttggaggaacgttcgattcgcaaaaataatcaacaagttaatcagcttttaaaaccgctattagataacgatgattattggacagtatcagatcaaggattaataaatcagtgctgtgagatgattaaaaaatgtagccgtgttattttaatcggttcgaatgagatgatggattcattattgcgttttcaaggtgatatggtgatgatgcaaaaacttgtgattcaaaatactatttataataataattatatcgaacctcaagcggatgatttaattattttgctttcaatgacaggaagaattgcggagttaaaaccaactttgattgaacatttattagtggggaaaaacaatcttatttgtgttggctataaaaattttctttgtgaaaaagccctatttttaaaaattcctagttacctagatgagacgctagaaaatatgattttagataactattttcaaaatatagcttattgttattatggtggttattatgataataggtaaactaaacttaattttgtgtacttcttcatataatagtaatgattatcttttagcagcgtatctgatcaaaaaaagtaatcagattgaatcaatcaagatggttgatattttaaaagatacaaaagtatcaaaatcaactttattacgttttttaaaaaaattaggctataaaaactacactgacgttcaatacttgattactaaagagaaaaaacatcaagaaatatttaaagagagaattattgagaaaaatttaagagataagttagcaaaaaaacaaagacttatagtaattggtgatagttactcagttagctcactaattgtatataaacaaaagttttatgaaattgggatagatttagatattcaattatcagtaaagtcatatggacagatggtagttgaaaaaaagtttactgggagtgacttaataatagtcgtatctctatataaaagtgatttggatttaatggcagaattttttagtggctatcttgaattgaaacattttattaaagaacaaaagattgatcatttatatgtaggaaagattgcgacggggaatcgtaatcttgatgagtgctatagaattgatgataacattaattttagtgaagcaatttatcagctttgtagtttgtttgagaaaatttataatttttatgctttgtaaggttcaaaatatgcccctttttattatttatcaatgattttctttattatagaaaccacgccaaataaaagcaatttcaaaatgaggctgtgataaaatattaatagaaaagagaaaaggaggctagatttatgagaagattaaaattaggaataatcagcttattatgtttatcatttatagaggctaatataacaacattgatggcagtagccagccgttaggtatatatttaccgcatgactatgatacaaataaaacttataagacaatttatcttgcacatggtggtgggggaaatgatgttgagtggatgaatatcgcttcagcaaataatattatggataatctaattgctgatggtgaagtggctgacgcaattgtggttactaaggataatacatattttaactttgaaaagggtgatagcctaaaaaatcttacagaatgcattatgctttacattgaaaagaattatagtgtttcagcaaatccccaagataaagtactagctggtctgtctagtggagctacagttacagttcaagcaatgttctatagtaatgaaatatttggctattatggtgtattttcaccgagtcgtacattagattttgttgaagaaacattaacactggaaatggttgcagcgtttcccaaagtatcacaatactatgtgagtgtaggaatttttgatacttttgttaggcggaatgtcaatgttcaaattaatgaagaattgataaaagccggagctaatgtagtttttgaatggaaaaatggagctcatgactggggtgtatggcgtagtcagttcagtgaatttgtaaaagattatttgtgggatcgtgaaacagtagtttcaactccatctaatcctgatgccgatgttgctccccaatcaaattcaacagctgctgtaaaaactggcgatagtgtcgatatgacaggattgttgatcataagcggtttatcattattaggaatttcaatacaatactattatagacatcgtaaaacacattaataaaaacttttaaataattagatataatctcgccaaagtagatagatgtgataatataatcttaccaagactatagaagtgagatttttattatggaaaaaattgaaaggtatagcaatatatttaagttttagaaagaacaaaaattaaagaaaggaaatcattaataatataagactattgctaccccataaaatgctagtttatatctagtaagttaattatttttgaccgtttgacaatagatacatataaatttataacatgactttttatttccctattgacaggtaggaaatagtttagtatactctattcatactataacagtaggataaggggaagaaaaatgaattttgaactactacaacagctcagaaataattttcggaatggacgaatgtattgttttttataaatcatagataacaaacattaagaaaagaggaaaataaaatgagtaaagacaatttaagatttgaaactaaacagttacatgtaggacaagaaataactgatcctaccggagcaagagcagtgcctatttaccagacagcagcttatgtatttgataattgtgatcatgcggcagcacgttttggattaagtgatgctggtaatatttatggacgcttaactaatccaactgaagatgtttttgaacaaagaatggcagctttagaaggtggggtagcagcattagcagtagcttcaggagcggctgcagtgacttatgcgattgaaagtattacacgaagtggtgatcatattgtggcagctaaacaaatttatggggggacatataatttattagctcacacactgacaaattatggtgttaatacaacatttgttgatagtgatgatcccgagaattttaaattagcgttacaagaaaataccaaagcgatttttatagagtcattaggaaatcctaattcaagtttagttgatgttgagtcagttagtaaaattgctcatgagcatggtattccattaattattgataatacatttggaacaccatatttatttaggccaattgaacatggagcagatattgttgtgcattcagcaactaagtttattggcgggcatggaactactttaggtggtgtaattgtcgattctggaaagtttgattggcaggcttcagggaagttcccacaattaagtaaacctgatccaagttatcacggtgttatttttactgaagctgctggagctgccgcctttgtaactagaattagagcagtagtattacgtgataagggagcgactatttctccgttcaatgcttttcttttattacaaggattggagacattatcactacgagtagagcgtcatgtagaaaatgctttaaaagtggttgattatttaagtaaacatcctaaagttgcaaaagttaatcatccatcactaaataatagtccttatcatgaattatatcaacgatatttctcacatggagctggatcaatttttacttttgaaattgctggtgacgaaaatgatgctaagaaatttatagataatttagaaattttttctttattagcaaatgtagctgatgcgaaatcattagtaattcatcctgcttcaacaacgcattcacaaatgaatgaagctgaattagcagcatctggaattaaagctaacactattagattgtcaattggtttagagcatatagatgatttgttagaagatatcgaaaatgcatttgaccatgtataaaaaataaaaatacgtcaataatataactagaaattgttgttgcttaaaatttctattgaccaaaagctatcccagaggatagcttttaagttattagtggcttataatgtaattgaggtgatcattatgagtgagttaactaaaataccttatgttggtaaagcaactgctgcatcattgaatttaattggttatgaaacgatagcttctttaaaaggcgctgacccagaagaaatgtatcaaaaagaatgtgatgttagaggacaaatggtagatcgctgccaactttatatgtaccgtatggcagtatattatgcaagtagtaaaaatccagatcccaaaaagttaaaatggtggatttggaaagattgatattgacaataattggaagataagttaagattacaaagatgaataaaggcgatgaatagaggagtaattgtattttatgtgtttaagagagtctcggctggtggaatgggataacacaggatataatgaaaaaagactaggagctgtatctaggatattaaggttgattagataacgtgagccacgttacaggcaaaactattatttgatagttgttgaggttaataaggtgacttattaacgaattagggtggtaccacgatactctcgtccctttagcggatgagagttttttatattttaggaggaaaaaatggaagaaagaaagtttagcgaacaagagttagttcgccgtgaaaaattacaagagctagtagataagggaattgatccttttggacaacggtttgatgttactgcatattcaaaagaaattaaggaaacttacggtgataagacgcatgaagaattagaagaaatggctgttgaggttaaagtcgctggaagaattatgacaaagcgtcgcaaagggaaagtgtgcttcatgcatattcaagatcgagatggtcaaatccagttatatgtacgtaaggatgcagtcggtgaagatgtttatgaaattatcaaaaaaggtgatattggagatatcgttggtgtaaaaggaaccgtatttatgacaaatacaggggaatgttctattaaggttgaagagtatactcatttaactaaggctttgcgtcctttaccagaaaaatatcatggattaagtgatgttgaagaacgttatagaagaagatatgttgatttaatcatgaatgaagaagctcgtaaaattgcttttgcaagaccaaaaataattcgttctattcaacattatctagataatcaaggctatgttgaggtagaaacacctgtattaaatccaattttaggtggtgccagtgcgagaccttttgttactcatcataatgctttggatatgaatttttatttacgtattgcaactgaattaggattaaagagattaattgttggtggtatggatgcggtttatgaaattggacgtttattcagaaatgaaggaatggatagaacacataatcctgaatttacaacaattgaagtttataaagcctttagtgaccttgaagggatgatggatttaactgaaggaattatttcaaatgcagctaatgaagtttgtggtacatatgagttagaatataagggaaataagatttctttagcaccaggatttaaacgtatttcaatgacagatgcaattaaagaaaaaacaggaattgattttgctgatcaattaagctttgatgatgctaagaaattagcagaagagcatcatattgaggtagaacctcattttggctatggtcatattatcaatgaattctttgaaaaatatgttgaagaaacaattattgaaccgacatttgtctatggtcatccaattgagatttcaccactggcaaagaagaatttagatgatccacgttttacacaacgttttgaattatttatctgtggtaatgaatatgctaatgcatttactgaattaaatgatccaattgatcagtatgaaagatttgctaatcagttaaaagaaaaagaattaggtaatgatgaagctaatgaaatggatttagattatgtagaagcattggaatatggattaccaccaacaggtggaatgggtatgggaattgatagacttgttatgttattaactggacaagaatcaatccgtgaggtaattttattccctcatatgaaaaataagtaagataattgcaagtgaatagagattgaaaaagctcgttataatcgtataaactcacgattttacgggctttttgctttgtgtgggaaaggagtgattttaaaaagaaaactgtcaaaaaactgtcaagaatgtgaggtggaaaaataagtaaagattgtcatcacagtgaggcgacaattcaaaacgattaaaataaataaaatattttccacgtagtaagtggaaaatcatgatgggaagaaatattggactcattgaatccaatattagaaagtttttatatgtgagtataagagtacggactaaagtactgactaaaaaaggctaccttatggcaaccttcaacctatgtatttgttatgtaagtgatactgttctagtaactgtaccattctttacatcaaattcaacaatatttaaattgaattttaatggtaatttatgacctgaaaaaagtccaataaacatttctattgtttgatctatttcattaacaacaatatcaacacgtttgaattcattgattttatcaaacatgaagaatggtgctatgaaatcagccacagttctttgatttacattttctccgtctttaatattacatctagcatgaaatgaatcaactaagattttattattaggctcacgttttttagtagcaacaccagaaaaaatcatttgtgaaccatctaatgtagtatatgaaggattaaagatgacattatatccattaaggtataaataacataagtatctttgatatacggaaattttattgatttcatcaggtgttaatccatttttttcagtaggtattgtacacagtatttgttgagcaatatcaattggttgaacttctaatatttcagctagtttatgtattgtttgcatacttggatttttaacattatcagcaagtatcttacgaattgcgacagtagtcatatctaacttgtttgctaattcatcaagtgacatatttgaattgtctattaaattttgcataaatgttgcataactcattatattcacatcctttacatgttgattataacatcattgaagtggaaaataaacactaaattaaataaatgcaaataaattattgcaaatagtttaaatctgttatatattatagttgtaaactaaaggcaataatatataatgcaaatagtttacagagaggagtgatgcttatgattgtattagagattgaaaataaaaaggttaattagccacgtctggtaaacttgctaattaaccaccaaccgaaagaagaacccttaggtatttttctttcatttagaattatatcaaattttggttcttctttctatcatttatgaaaggagatttaaaatgccaagttatacacaagaagaattgttaaaaaaagattttaaagatgttgataaaggtattttcggtggattgcttagaagtggattatatattctaggtgcaacaagtaaagtcggaaaaacaatgattgcaacatcattagccaatgcagtagcaactggtacagaatatttaggaagaacgaacagaaaggggaaggttatttattttgataatgataactatgattttgaaacgaaagatagaatactagccctaaaattcgttggaacacctaatattagatatgtatttggagaagatgcatcaagtattcgcaatgttaaaaatgaattgaaatatgaaatagaggacttagaaaattatatattagtgattatcgattcatttattggactagatgaatttattgaagaagatcaaagttatcaaaaattatatccagttattaaagatttaagagatttcattatagaaagaggtttagtatgtattatcttacatcatacaaagaaaggtgaagcaactggacaagataagttaattggttctaaagcaatgactggtgcaactactggaacaattattatcaatgtagcaacagagttttctaaaacaggaacgctagaatttatcttaagacataaaaaagatagtattccaattaagaaagatgttgatgatattaattggattcttggcgaagatgaagaagatggaatggaggaaattccaagaaatattttaaacttaatcaacgcagtagtttctagagaaagcaaagaaattaaaggtacagcccaagaaggtgtaaatgaaactaaaatggaagtcaatcctttttctttgtttaagtatctagtaaaacacaaagaaattcttgaacaaaattatatttattttgaaaaaggcaaatcgggaaaaagatttattttagttcgatatgaaggagaaaacgtatgatttgggacagttggacagttacgaacgtatatgctttaaagtgtccgaagtgtccaatgataagattaaaattcgtgattaaaaaatcaaaagcaacaccaaaaaaatatggtgtagcaagttataccaaaatgcgtggcttttggaaacttgccctgctgggagcttttgttttaagtagtgtgatgtaaatggcacacgttgaaaagtatatgagaagtgatattacaggtttagcaattcattatgaacgtcgtgatggacatcagttatctaatgaagatattgatataagtagaaagcatttgaattataatctagcaagtgaattacaacctttaacatcagaacaatttatcaaacaacgattaagtgaagtgaaacatatcaatcgtaaagatataaaagtgatggtagattggattgtaactttaccaaagaatgtacttgaacaatacgaagataacttctttaaattcacttatgaatttttaaaagaaagatatggtgctaaaaatatagttggtgcatgggtacacaaagatgaaaaaacaccacatattcattttagtttcgttccagtaattgaagttgatggagttgaaaaattgaattgcaagacaataatttgtagatcagaattaaagaggttccatccagaactacaacaacatttagaagagaaacttggatatacaccagaaattttaaatgaagcaacaatcaatggaaacagaacgattaaagagttaaaacaacatgaggatctaaactttaaaaagagtataacgaatatcacgaatcatataaatgcaagtcaagaaatagttgcacaagcagagaagattgactttgaggcatcaggattattggaaaaaacgaaatcactaaagaaaagtaatgaagtgattgatgagtttaaatatcaaaataaagtattacaagcagataatatatctttaggtcaattggttgttgttcaaaaagaagaacttgattgttatcgcagaatgcctttggcaaaacaattaaaagagaaagaacaggtaattgataatttgtattcatccattggttcgctcgaaaaagagattgatgattataaatatgataattataaacttagagaaaacaatcatatagcgactaataagattgacaagttaaagcaagaaaaacatctgtttgaaacatttattgagatggtcggtttatcaaaggtgtttgaaactttcaaaagaaagtatattgcgaatgattatcaaatagatattcatgatttaaaagatatttgtgagaaagcaatttccaaagtgaaaaaagtgtttgaaaccatctcaaagagaattgatttcttgaacaaaaataataaagaacaggatgaaataattattcatcgaaagaaaaacgaagaacatttacgttaggaggtatattgtatgacagatttaagaatgtatacacaagaagaagtggcagaaatgttgcatacacatattggtacgattacaacattaagagaaattggtattctacctgcaattagaactggtaagaattatatgattactaaagaaagtattatggagtttcaaaagaattatgctggattagatgtttctaatcgtgtaaaagcaattgaagcttatagattagttaaaaatagattggaggcttaatatatgtcgattcgtaaaagaccaagtaagaaagcattgtcggggtacacttatcaagtgtacttcccatatgttgattctatgggaattcatagagaatattttaaaggtggatttactacaaagaaagatgcgcaaactcatgaagcaattaagcgaaaagagtttatggattatggtgatgtgttggcaaatagagaaattacttttaatgaagtgtttgaggaatatatggaagtggaaggtatggcgaaatatgctcattcaaccaaactttattatcagaatacctataagaaacatattaaaaatacaattggtatgtgtaagttaagaatgttgaaatataaagatattcagaaatattttaatgatttaaaagttggtttaagtacagcaaaaaatattaagaaagtatttcatgtaacatttaaatacggtttgcgtgctgattatataagagaaaatcctatgtcttatgtacagttgcacattgaacctaccaaaaatgaagaaaaggaaacaattgtgattacaaaagaacagttagatgaaatgttacaaaagattattgtggtaaataaacatactcgtgattttgattacacacagtttaactattactcatatgcagttgctttatttatcggttggtatactggacttagaattagtgaaaccttagggttaaagaaaagtaactttgatttagaaaataatacgattaagattgaaagaagattgcagtatcatggtgtacgaaagaaagatttacatgatacaaagagattgaaatcaaagaaagcaaatgcgatcttgcctatggcagaaaagttaaaagaaggtttgaagatttggtttgagaaaaatccatacgataatgtaatttgtgatatttatggtaataagattttaccagcatctatgaattatcgtgtcaaatgtgttgcagttgaaatgggtatcccagaatttcattatcactgtttacgtcatacattttctactgcattagcagataatgatattcgaccaagagtaagaatggagctggttagacattcaaatattgatttaactgaaagagtttatatgcatgtgaaagaatcaagcaaagtaaaagcgattgaaaatgtgtttggaaaggaagggatgtagtatgaataaaattgaatatagcaaggttggggattattatatccctaaccttaaagtaaaacctagaagaaatgtatcattaggtaaatatggaagaatgagattaaattatttaaaagaacacgagagtgcacattacaatgctctcttgatgaatgatgaattatatgatcatttgattgagatagataaacaagcttatgaaatgcacgatagacttgttgaacagtataaagaaaaatggacaattactgaagaattaaaacaaacgaatcaaatggaatgggttagacagatgaatttgataaaaagaataattgaacaaattgtgtatgatgctcttattatgaagtaaaaattactccccatgaaacgtggggagtagtttatttagataaaacaaaaatatattcatgagctaagagataaaaattaagattttgtattttgctttgccagtattttgttgaactacaattatgttgttccttgattataatctcttttaaagtgaagccattatttaagaaaacttgcattgtattaaaacctaaaggtataacattcccattttttctaatatcgccaatcataaaagaacaattatgtccttgttttaaaacacgatacaattctttactcactttatccatatgtaataaaaaatctttataatctagtaatgataaatcgttctcaagatttttactatatttgattatatttgtataaggtggatgagtacagatgaagtctattgaattatctttgagcatagtcatttttttagcatcacattgatataattcgattttagcagaattgtgacaatcaaaatgtaatcgttttttagaaatattgagagcatcattgttaatatctactccaatagcatttctatttaataattttgcttcaataagtgttgttcctgaaccggcaaaacaatctagtataagatcattctgtttggtatatttgagaattaaatttttagggatatgaggagaccaatttcctctataatcgcctttgtgtgtagcccaacttcctcgatcaggaaaactccatatagttgtattttgtaattcgtatgttttcatataaaacacctcctattatatatatacgtagaaaaatacaaaattcctttaaaaaaatgcaaaaagatttaattttctttagttgagtttatttttccttgaaaaaattcgtttttatttagttttacctgagaatatgataaaatagccatgatataggaaggagtgtttttaatggcaaatcagaaaaatttagtattaagtccagttttaaaatgggtcggtggcaaaagacagctattgaatgatataattcctatgatacctaaaaattgttcaacttatgttgaaccgtttattggaggtggggctgtattatttgaattacaacccaagaaagcgataataaatgattttaatagtgagttaattaatgtttatacagttatcagggactactctgaagaactaatcaaagaattacaatttcacaaagataataatacatcagaacacttttatgcagttagagaatatgatagaaaaccagaatttttttctcaaatgacccctgtacaaaaagcagcaagagttatttatttgaataaaacttgttataatggcttgtatagagtgaattctgctggacagtttaattctccatatgggaagtacaaaaatccaaatatagtgaatgaaacggtcattagagcgatgtcaaagtatttcaatgaaaataatattgtcattaaaaatgaagattttaaagaagcattaaaaggattgagaagaggtgcatttgtttatttagatccaccatacatgccaatatctagttcatcttcatttacaggttatactgaaaatggttttaatgaagacaaacaaagagaattaaaagaattatgcgataaattagataaaaaaggtataaaattcttacaatcaaattctgattgtgaatttatacgagagttatatagtggttatagaataaaaactattaaagcgaaaagagctattaatagtaaagggaattctagaggagaaataaatgaggtgttgatatacaattatgagtaaaaataaggatttatcagtagatgaagcttgggaaaagttattagaaaaatatgacattgtaaagaaaatagaagaagatgggatatttcatattgaggcttcacaaataaaagaatttaaagagccgagattaatgtcaaaatgggatagttcagaacaattgccttctgctttgaagcgcaataaaatcaatatcttgcctaatagtagacgttcttatgtattaggagattttcttttgtaccaagatattcctgaactggaagaacatgtaacaaaaatgactgcagtagaattaccagaatatgaaagtatagatattaacaatattacatctgaagctaatgcgattaatgtattaatattatcaaaaatattagatgactttttgggtactgatgaaaatgttggtacatttaatgggcgtatgggtacaggtacatttgatttcgatgttaatactgtgggaggatcgaaacaacatattctagtcaataacgctcaatgtgaaatagatggtggatttgaaaattcagagtcagtagtaattatggaagccaaaaatgtagtccatcctgattttcacattagacaactttattatccatatagattatggaaaactaaagttaacaaaccgattagacttgttttctcaatatattcaaataaaatttatcgtttatttgaatatgaatttactgatataaacgattattcatcaatcaaattgattaagaataaaaactattctcttcaagatacagaaattacattagaagaactaattgaagttagaaatgctacaccaataaagtttgatgataatcaagaagataagagtttacctccatttgttcaagcggattcatttgatagaataatttctttattagagaatatgaatgataatccaatgaatgatgaagaaatagcagagttaatgcattttggttctaatttaagtaacggaaaaccagttttcagacaatctcaatattattacaatgcaggaaagtatttaggattatttgaaaagattcgtactgaagaaaatgaagtgaaatcagttttaacatctttaggtaaaaaaatttataaaatgcaatataaagaaaggcaattaaagttagtttctttaattttagaacatcaggtatttgctgatttctttgatgagattattgcgaattttggtgaattacctgaaaacaaggatattcaagaaagaatgagagaattaaatgtttgcaacgaaggacagattgctagaaggtcacaatctgtaagatgttggttgaagtggattttcaatttaattagattatcataaaaggaggtaatttagtgaactttttgaataattttcaatctgaattaatttctcaaacatcaatagttcattatattgaatttcaatttgaacaagaattaaacaaagtaagaagatatcttaatgttgaaattaaagatgagctttataataataattcaaattatatgaagttgattctttcgacttgtgatgagttattaagtcgaaattctaaatcttatgttgcagagaaagagttacctgctatcgctagaaatgttgatgttagagaacctataggtgaagtgattgaatattgcattgaaaccttggaagccggaggagaattaggagttgctgagttaaaacaagaattagataaaataaacaaagaaaatgatgaagattattgttactatgattttacagaacagcagatagaagaaatgattgattctgcatacattattaaagattatagaaaaaattatgaattgaaagagcgagatgaatgatcaaatatatttagacaatcttttataaatattttttcgatttttgatgcttatgtatttgaatatatagaagaattcttttgtgcttatccaaaagaattaagcctatttttagaggtgaaaaataacgaaaaattaaatttactttagacgaagtagtagattttgaagatatagaaaatctaaaaaacgagatgatacataagcaacttgcaggtagatacttgagcgaattaataaataaattaaaaaaatatagaccttctctatttacaggtgttgaatatccagtgttaatggaaatgatcgaacgtagaaatattcatttacataataagggaattgtggatgaaaaatattgtggtttttttaatatatatcatttttgtgatggagaatacgcatttattgatgataaatatttattcactatagtttttaatacattatctcaatttaccaaaaacatggaaaaagagttgaatattgataatgtaaaatgatgatttaaaaaattattttctattaagagagtaattttttttattaatttattgacaatataacgaaatagcgttattatgataatgcgatatccggaatatcgaattatatataagtctgttaatattatggtgttaactagacagaaaagaggtaaatatgttagaaaaaacaatggtggtaaaagatagttcgtttagaaagttggacgatccatttgaaaatggaaaatcaagaaaatacgtgttttatgtaaaggttgatgatgttgctgaaggaattccaatgacaacaaatccaagagatcagaaattgacatcaaatgtagcaaaagcgattactgactctttgacaagcaacgatggatattttcatttgaaaaatagaggtattgttgtatctgcacaaaaagtgaattataataataaaaccggaaaggttactatttattttgagaatacacaatatcatgggaatatagatggaggacatacttataaaattgtatgtgatcacaaaggtgaaaatctagaccaatatgttcaattcgagataatgacaggggtagaagatataattgaaaatcttgctgaagcaagaaatacgtctgttcaagtagatgaaaaatcaatggcagaattagctcaaaaatttgatcctataaaagaagctttagaaggcatgcctttttatagaagaattgcatttagacaaaatcaaagttcagttgatgaggaaacaggacgaaatgaaaaaatgattgatgcacgagaggtagtcgctattataaatatgtttaatgttgataaatttactggtagcaatcatccgattcaagcctattcgtcaaaagcaaaaatgttaagtatctatttatctgatgtagaatcatatagaaaatatgtaaatatcattccagatatttttgatttatacgatggaattgaacaagagtttgcaaaggcatataatgaagctggagaaaaatatggtagaaagaaatattctggattcaaagatggaaatgtaattgcaaaaagtaaatttggattacatgagttacaatacaagattccagatggaataatgtatccagtagttgcggcatttagatcgttagttaaatttaacgaaagtacaggaaaatatgagtggaattcaggggtaaatcctctaaaaatctgggacaaatgtaaaacagaattagctagcaaggtgatgagttttgcttcttcaattggagataatccaaatgcagtaggaaaagatcaaaatgtgtgggatttagcatatatgacagtgcttttaaataaaagcaattaattttgtatcaataagtaaagagaataattaattgaatggagggatattcttgacatatgaaattaaattaaaggtaaaggatttgattgatgaaaaaggaatgacacaaaaaactttggcacaactatcaggcattcgagaatcaacaattagtgatatagtacgaggtacaagaacagttataaattttgaacatttgtcaaaaatagcggaagccttgaaagtaaatgatattagagaacttattgattttaaatagtaagtattgagaatgaacaaatatgaatagtaaaatatattggaataactgtcaaaaagctgtcaattttcttttaaatggtgtacaataaggatacacaaatgaaaatattaagtatttaagggatattattgaactgcttattttcctatataacgatactttttcaatctcacatgaagaataagtaaagtcatgtattttcttgtgagaatttcgtgagaatgaagcagatttcttaaatgatatctgctttttatatgcatgaatctaagaataatatcatttctttcaagcactataattacgatatattttacaaatatattgacgaatatcgatatgtatgttaatatcacatcgaagaagatagatatgaggtggtttgatggaaaaacagtttaatcaagatgctaaggtttttaaagcattctgcgatcctaatcgtttaagaatattagatattttgaaatccggtgaacattgcgcatgtaaattgttagatatattagatgttagccaatctacgttatcgcaccatatgaaactgttaactgacgctaaaattgtaaatgttagaaaagatgggaaatggtctcattattctttatctaaagatggtatacagtttgcaatagaatatttacaacagctcaaagtatgaaatatgtaaataagttaactgttgtataaattaccaccactaaataggtggaaatttatttgttttatacatcgaaatatatcgatataaggagggtgctatgagtcaaattttgctgttttttcaagaccagattcttgggatgcgatggttaaatgaattgattggatcaatattaactagcattggattaaatatagatgaaaaaataggtgggatgttgcatttttttatttatgatagtattaagatatttatattattatcggtattgatttatattatttcatatattcaaagttattttccaccagaaaaaacaaaaaagatattaggaagattttatggtatttgggcaaatatattaggagctttacttggaacagttacaccgttttgtagttgttcatcgattcctatcttcatgggatttacaagtgcaggcttacccttaggcgtaacattctcgtttctgatttcttcacctatggttgatctaggagcgctgatattattaatgagcatattcggatggaaagtggctgtgttatatgttatagctggtttgattatatctgttgttgggggaaggttgatagaaaaacttggtatggatgaccaagtggctgattttattaaacagacagataatgtagatgttggttttgtgagcttaacagtcaaagatagacgaaactttgcaaaagaacaagtcatagaaacagttaagaaagtatcaatatatatatttgtaggtgttgctattggatcagtcattcataatgtaatacccgaacattggatacagtctatactaggtgatcataatttttattctgttccacttgcaacagtagttggtgtacctatgtatgctgatatatttggaacaattcctgtagcagaaagtctattgttaaagggggcagggcttggaactgttttatcatttatgatggctgttacaacattatctttaccatcaatgattatgctatcaaaggcagtgaagagaaaacttatgattgtatttgtggcaatagtaacagtaggtattatatctgtaggttttatgtttaatatattttcatttctattattgtagaagatatgtttaatatgagaaatattgtacattttaatataacgatggagattaattaaatgttaaaaagtggttttaactattcaattcactcagttggtggatgtacatgtttggggttataattaaggtaggacgggaaagaagattttgttaaagaaattattttagttataaatcaatatctagatgataaatggatgatggcagttcctagataagaaaatccattattagatgttgtctcaaaatttaattatgaataaaaggagaaataagtgatgaaattatttaagaaaaaagagaaaaattgttgtaatgttcaatgtggtgatgggagtatgaagagaggattggaaaagaaagataagggttcaagaattaaagtcttaggttctggctgtgctaaatgtgcaactttagagaaaaatgttaaagaagccttggatgaattaggacaggaaatgagtatagaacatatcacagattttacagaaatagcaagctatgggattatgtctacacctgcgcttgtaattgatgagaaagtagtatcttttggaaaggttttaacgatagaagaagttaagaatatcatattaacaatagatggatgaatcattgaaacaaggtgttttttgtgaaggggatttaagcgagatgaaattgcttattattgtttttatttaatattaaacaatttgaaaggataatttgaaagaaatgaataatatgccaaaagtcgcatttatatgtgttcataattcttgtagaagccagattgcagaggcaatagcaaaattgtttgcttctgatgtatttgaaagctattcagcaggaacagaagtaaaaccgcaaataaatcaggatgctgttaggataatgaaaaaacgatatgatatggatatggaaaaaacacaacaccctaagttactagtcgatattccagaagtagatattgttataactatgggatgtaatgttaattgtccatttcttccttgcagatacaaggaagattggaatttggatgatccaacaggtaagagtgatgaagaatttggtagagtgatagataatatatttgcaaatattaatgaattatctacaagaatatccaaaatgaatatctaaggcaaataaaatttataggatagggagtaattctattcttgttgagaataattattatatatttcaactgacacactttccatctaatctttatacgcccataaataaaagtcatagattttccgtaaaaatagaaataaataatcttcaaaaatatattaaacataataaaaatatgattaaatcagtactttttgattttataaaagatgtactattacgttacacatgaagaaaaaatagataaacaatcaggcaagatgtaataaggatattgttttatttagtacacaagttctcaatattaaaaaaggtaagttgaattgaaatttattttttttagtacgtataattagttgaaaaaattaacgacaggagaaaatatatgaaattataaaaaatataaagataatttgattaagttttggattgacactttcacatgttaagagtcaattttttaattaccatagtttagcaaacaaaatttactttattcctgctatacagttttattttcaacaaagcgctgcaataaatatagtaatgaattggaaatagtatcataaaatataaagtatataggtaaggaggaagtaaaatgaataataattatgagcttggaaaagtaattgtagcattaaatataaatattacttctaaagatgtactagactattatattgatcttgttttagatgggattgattatgaaaaagcagaaataatcttccattcaaagaatactgaaagtctaaatgagggaactaatatagttcttatttatttaaaagataaaaatcctcatgcagttactaatgcagttgcaaaattatcatcaagtccatatattgtttatgcagaaccggattatattgaagaaatgcatattatctcaaatgatcctttatacaatcagctttggggaattcaaaaaatcaatgcaccgcttgcatgggattatacaactggtgatagtagtatcagtgttggagtgattgatacaggaatagatcaaaatcatccggacataagagaaaatatgtggactacgtggaatagaagattaatttatggctggaactttgcagataatagtagtgattcaatggatctagatggtcatggtagtcatgttgcagggacgattggtgcagttggaaataatcgtattggtattactggagtatgctggcaagtaagagtagcagctttaaaatttggtcttgatgttgcttcggcaattgcggcaatagattttgcaaattattataagatttctattttaaatgccagttggggtggacgagcttattcacaagctttaaaagatgccattgatcagtatgatggcttatttgttgcttcggctggaaatgatggaactaacaatgatgttgatccaatgtatccagcatcatatgattgtaaaaatattatttctgtagcagcggtcgatccctatgatactttagcccgtttttcaaattatggtcttaaaactgttgatatagcagcccctggaacaaacattctcagtcttgaccttgctggtgagtatagccccttgaatggaacttcaatggcagccccacatgtagcaggagcagcagcgttattaaaatcaagtatgccgaatatctcaacaataactttaaaaagaattattttatcaagtgcgatggaaaacccagaacttaagggaaagatattaacgggaggaatattagatatggaaacaatgtttaaactagctaactgctggcatggacgagaataacaatatatatctaataaaaatgtgatgaataagaaaaataggttataaaaacattttaactattctttaaataatttaaaatagaataaaggaagtgagaatatgtataaccctcaattagaaacatttataaaggttgttgatcgcggtagtttctctaaagctgctgaggacttatttattagtcctagtgctgtaattaaacagataaatattctagagacaaatttgggtttaaaacttctaaaaagaactcatcaaggggtatctttgacaccagcaggagcatctttatacagggatgccaaatatttaattaaatatgcaaaggattcaattgtacgagcacacaaggcgatggaaaaagaagaaatggtaataagaattggaacatcaaatacaacaccaagtcaatttcttatcgatttatggccgcggattcatgaattatgtcctaatttaagaattcaactaattccatttgaaaatactccggaaaatgctcgagaaatactagctaatttaggcgataatattgatttggttgctggtgtatttgaaaaggataatttcaaacagcggggctgtgattctctagaaataaaaaaagaatcaatttgtcttgctttatctatttatgatgaattaagtaacaaagataagctgtctttgcaagatattcatggacgtgaattaatgctgattaaaagaggctggaataaatatgttgatgaaatgcgtgatgatttaattaaaaatgatcctactattataatcaaagagtttgagttttttgatatctctgtttttaatgaatgcgaaaataataaaagtttgcttatgagtgtcaagagctggaaaaatattcatcctttaattaaaactattccagttgaatgggattattatatgccttatggtttattgttttcattagagccttcacggcaagttattgagtttgttaatgcagtaaaaagagttttagatatatagtatcgatataaccctaaggttatatcgatactacttattgagacttctatgtttataaataattatatattataaagatgcaaaagaaatataaatataggagaagataaaaatgagaaaaacgagaatattaggtcaaggattagaagtatctgctattgggcttggatgtatgggaatggatcatgcttatggggctcctgctgatcgtgaagagatgattaaattaattagacatgcggttactttaggatgcaatttttttgatacagctgttgtatatggtgaagcaaatgaagttttattaggtaaagcattggagattttccctcgagatgaagtaattattgctacaaaatttggtatttatggacaagaaatcgttgatggtaaaccacaaaatattttaaatagtaagccggattcgattagagaacaattagagggatcgttaaaacgactaggcgttgattatattgatctatattatcaacatcgagttgatcctgaagtagaaccagaaatagtggctagcgtgatgaaagagttaatagctaaaggaaaaataaaacattggggtttatcaaatgcaccattagattatttaaaaagagcacatgcggtatgtccagtaacttgtattgaaaatcagtattcaatggtctttagacagcctgaaaaggaagtgtttaaagtttgtgaggagttaaatgtaggatttgttgcttattctccactaggaaacggatttttatcaggtaaatatacgccagcaacaaagtatgctgaaggtgattttagaaataatatgggacgttttaatcctgaagtaatgaaacgtaatcaggccttattagatttagtgcaagaaattgctgaacgtaaaaatgctactagcgcacaaattgttctagcttgggagattaatcaaaaagattggattgttcctattccaggaacaaccaaaatacatcgtttggaagaaaatttaggagcaatggaagttgagttgactgaacaggagatggcggctattaatcaagcattagacaatcttgatattgatgaaacacatttttaagcagagaaaagtacaaaggaatttgtactttttagtgttatacgtttaatcctgaataatgaataatatagaaactatcacggtgtatttagttttggaaaagtgtattatttggtatatcggcgttattagtctataatagagttgaaagaaagccggtggtaaaatgatgccctatatattgatcttggttattctaacacttttatggttaggcgcattttggaggataaaaagaaagcaaaatataaacttgctagctggctttttatttttcatgtttttaagtacctttgctagttttttagtaatgttaggaattaattattcaaatagattagtatatttattagttggtgtaatttttttatttgccttgtttgttttattatttggagtctatatcttaattgcattcttattaataaatagtgttatcattcttcgaaaagagaggttcagtctttcgcatattttgactttgttggtagcggtagggataattttactgattacactatcatcatttttaggtaggattaatccaccattaccaattatggcattgtggagtggcctgatcgtaatgatcttatttcttacttttcatattttcttatttatagaaactttgatattaacaaatctttttcatcctagaaagaatttaaattatatcattgttttaggaagtggactaattaatggaaatgtttctcctttattagcaaagcgtatacaagcggctttaaagtttgctaaaaagcaagaaaagaaaaaaggatttgcaccttatttgttgatgtccggaggacaaggaagtgatgaaacgagagccgaagctctagcaatgaaagagtatgcgattgaacagggttatagtgaagaattaattataacggaagaaaagtctaaaaacactcttgaaaacatgcagttttctaaagcggtcatggaagaaaaaagccatggtgaaaactataaatgcgcttatgccagcagtagttatcatttaatgagggcaggtatttatgcccgccaagttggtctgataatgagcggattaggtggtaagactgctttctattatttagccaatgctgtattaagagaatatattgcctatctagcaatgaataaaaagctttatttggttgttttagggagtatttttatgtttggaactttaatgtatattttgtttagtgcattaattggttaaacaggggtcaaaggagattaaaaggtgaaatatgaatggatagacagttatttattagcgaaggcgggaatttctaaaaatcttcaaacagaatggaattggattagatatgttattgacggtaagatgtgtgtggcagtttgtctagatgaacaagataatccatattatataactttaaaattaagaccagaaaacggaatggatcttcaagaacagcatgaagatataattcctggttactatatgaataaaaaacattggaattcaataaaagtaaatggttcgattagcgatcaattactaaaggatatgttagatgaggcttatgagttggtattgtcgagctttagtaaaaaaagacagttagagatattatctttataatcaaaaggggaattttgatgaaacgatgcattggaatgacgggaatagtttggaaatttaaaggaggattaaaatgactattctagaaaagaagattgctaaaaatattgatattattaaatctggaaatattacaagattaaagagggaagatgataaaaatcatgaatttatatattttcatgatttttttagttgaaatgtattctttttataagcaataataccatttttctgtagtttacttaattcactagataaagcacttctctctactgctaagtagtcagctagttgttgacgattaaaaggaatttcaaaagttaaagaattattttttagtgcttgcgaatttaaataagaaagaattttttcttgagttgttcgtctagttaagtgatgaattttttgagttaaaaggacatttttgtttgagacgattgaaaggagattttgaattattttatgatgaaaagaacatgagtgttggcatgatctaataagatgggagatatctaagaaaagaattgttgttatttctgtagctacgacatttaaatcaatttcttgttgtaaggcacaagcataagattctaaaaagaattcactagctttaatttcgctaataattgttttattaccccaaaaatcaatatgataaatatgtgcttgaccgtcaagaactaatccaatttcatgaataatatcaccttgtctgataattgtttcgtttttttgatatgttttttcatggcttttcaagcagtttaatagtttttcaatttcagcaggatcaattcctttaaataatgaacattgttttaaaatttgtaattttttcataatttgctccttttgttgtaaaaacaacataaatgttataaatactttattatagtatggctgtggagtcaagattaatactctcgattaatgtgattattaaaaatatagagattataaaggagaaattatgatggaaaataaaatgttttgttatcagtgtcaagagacagtaggaaatcagggatgtagtcaagttggtgtttgtggaaagaccccagaaacagcagggctgcaagatttattaattgatgttacgaaaggcttagctgaggtaattaatgaggtacgttgtaaaggtaaagaaatcaataatgtatatgatgatcaagtgagtgaaaatctatttattacaattactaatgccaactttgatgatcaaatgattattgaagctgttagaaaaacacttactttaaaaaaagagctgcttttacagttagatgatcaagctgtactttcaaacagagctctttggatggagatggatatagaagcaattgagaaaagaatgcagatggttggagttttagaaacagcagatgaagatattagaagtttaaaacagctgattacttatggtttaaaaggaatggcagcatataataaacatgctcatgcattagggtttcgaaaagatgagattgatcgttttattgaaactactttggttaagattgaaacttcagcgatgtctttaaatgattatgtagcattaacgatggaaactggaaaatatggtgttcaggtaatggaattattagatcaagctaatactagcacttatggaaatccagaaataacagaagttaatattggagttcgaaataacccgggaattttagtttctggtcatgatcttaaagatttagaaatgctattagaacagactaaagatacgggaatagatgtttatactcatagtgagatgttacctgctcattattatccattttttaaaaaatatccaaattttgttggaaactatggtaatgcctggtggaaacaaagagaagagtttaaggcttttaatggaccggtcttattaacaacaaattgtttagtaccgccacttgctagttatcaagaacgggtttatacaactggagcagttggttttgagggatgtgttcatattgataaagatgaacacggctacaaggatttttcacaaatcattgagcatgctaaaaaatgcttagctcctactcaaattgaaactggtaagattgttggtggttttgctcatcatcaagtacttgcgttggctgaccaaatcgtaacagctgttaaaaatggggatattaaaaagtttgttgtaatggcgggatgtgatgggcgtcatccaacccgtcaatattatactgattttgctcaaagcttaccgacagatagtgttatcttaacagctggttgtgctaaatatcgttataataaactagatttaggaacaatcaatggtattcctcgagtattagatgctggtcaatgtaatgattcttattcactagcgatgattgctttaaaacttaaagaggtatttgcattagaagatattaatgagttaccagttatttataatattgcctggtatgaacaaaaggctgtaattgttttattggcattattatcattaggagttaaaaatattcatttaggaccaactttaccagcctttttatcacctaatattgttgattttcttgtagataattttcaaatttctggtattcaaagtgttcaagaagatttaaatttattttttcctcagacaaaaaaagaagataagtttcatcgcgatatgctagttggaagtattattggtatggatccacaagcagcacaaattttaagcgatagtggaatggggtgtcttggttgtccggcatcgcaatctgaaactttagctgatgcttgtctagtccatggtttagatgttgaagaaattttaaaacaattaaatcagtaggaggaatttaatgagtgcgtttttagggccagtacattattggttatatagaaaaattcaatatcaagaacaattaaatcaaaagattcttaaaagaatttgtccccagcttaatgagattgttgctcaggaatgtggcacaattcaagatggaagtctagaggaaattattgatcatcaagcaattcatcaatggctttctatggaattgatgatagtagaaaaacgatttgcatttattgttgaacatatagaaaaaagtgattttgaggaagttagggaagtgttgttcgaggctggcaaagaaatttcaatcaatgagaactatcataactgcatagaattattcaaagtaattaataattaccttatcgatggaatgccttgtgataaaggtattaaaataatgagccaagaggaaaatcaaattatttatgaatataatgaaatggttcatcaatatttagattttgaaatatttcaaaaatatcgcaaagcttggcttgatggggtactttcagatagccatatagtattttcaagacttaattataatacttatatgttaaagatggaggaataaaatgacaaacaatataattaaagatttagaagctgatcatcaaaaaatattagcatttgttaatgaattagagcaacgtttaatagaatttatggaagcaaatatttttgattatgaacaaatgaaaagagatattttatttattagagagtttgctgataaagaacatcatcagcgtgaagaaaagattttatttagatatatgatagagtatttaggtaaagttgctgaaaatttggttcgacatggtatgattgttgaacatgatcttgcaagattgtatgttaaacagtgggatgaagcacttcaacgttatcatcgcaatcatttgttaattgataaactaacaataatttcaaatggacatgcttattgtatgttactaagaaggcatattgaaaaagaggatacagtagtttatccgtttgctaaaaaacatttatcagaagaaatctttgctgaaatgatcaaagaaaatcaaaattattaagtataatataagtgaaaagcagctatttttgtaatagttgtttttttattaaaattacttaaattgaggagtgttgcaaatagtgatataattatgttctatagttatgatagggggtagagtgatgataaagaaacataagccatttattgctgcaattttaatatttatgataatgagcattctatcattttttatcttgtacggtgtcattaatgataaggtagcagcagccaaagagaaaattcattattttacagaggctcaagttagtcagctagatcgggtcctgtcttcgtatattcaaactgctgaaacgttgaagctgctaattgtagatagtaatggtaatattaatgattttgatcgagttgcacatcaactatataatgatgataatacatttagaagtattcaattagctccgcagggagacgttcaatatgtttatcctcttgaaggtaatgaaggagcttttggaaatatcttcgaagatccagaacgtgcaacggaagctaaaaaagctcgtgatactggggaaactaccttggctggaccattcgaactctatcaatcaggaaagggaattgttgttcgacaaccaatttatttagaagaaaatggagaaaataatttttggggatttgcaattgttgttttaaatgtaccagaaatttttgattcagtacatctagattcatttgaaaatatgggatatgaatatcagttatggcgtattgatccagataataataaaaaacagattattttgaaatccgatcatgaactattagatgacacaataaatttaagttttgaagttccaggaaatacttggactttgagtgtttcaccaattaacggatgggttcgaagtagtgatttaatgccagttattatattagctatctgtttgtcattgttgataccgttattagtttatacattactaaaaattaacgaacagcgccgaagaatgatcgatatttctaatcgtgattatctaacaacgctttataatggtcggaaaatgaattttgttttaaacgacttaattgctcgtcaaacttcgtttatttttgtttatttagatgtagataaatttaaagttgtaaatgacacatatggtcatttagcaggagatgtgttattaaaagaaatagctttacggatcatgaggtacttatcacgagaggattatgcttttcgagtaggtggtgacgaatttgtcatcattattaaaaataattcttccaccaagaagaccctccaaataattgctgagcaaataacagaaaagataaatttagatggctttgaatattatccggaagttagcatgggatatgctgtttatcctaatgatggcaaaagtttagaagaagttattaaatgtgctgatagtcggatgtatgaaatcaaaaaacataagaatatataatataaaacacagtgattgttaaatgatatgattcctcataagtagtttttggtcatttgccctatctacttgatagagagaatatcaaaaatagatcactgtgttttttgttataaattagaatattgttgtggatcaatcaaactagcagctgcttgatcgcaaataacagtaaagttagggtgaagctttaaaattgttgccggcacatcttgattaacaggctcatctaagaagcgtttaaaaatttctgctttttctttaccattaacgatcatgactagatgtttgactcgcattagacttttaggacccattgtcaaagtatgaggttgtcgaggacggtctccataatctggattaacggcctgctttttcttgaaatcaatacagtaagtataactgtcaaaaggtgtacaacgaggacaattaccacaaaaatgtccatcatatccaagaccaatcaccattacatcaattcctccagcatttctaattttattatcatagtcttgccagtcatttgaagtcataatgtgaatacgctcatcaggaatattagcggctttaaaaaataattcttgcatatccttccagtttggtccataaggttcatcaatatatgggttttcatcaaaaagataatactcaatatctttaaatttagcctgattttttacataaggaatcatcatgtcatacatcgtcttaggagaacgaccggaagtaagtgaaatattgacacgtttatcttgcatcatggcacctaatagaataaacattgcactttcactcattttttgttcattttcttcaattattagtttcattttagtaagctccttttcaatttttgattaaaatgatgtaaataaaaaaatgtaatatataatttaagtatactgtatttttttagatacacaagtttatcggttgtaaatgatcaagaaaagttaactatatataaatcaagtaatttttgataattagctaaaatattttttagttttttgaaaagtgaattttggttacgctgaaaactactactgcatgcagctttttaaaaatattaagttctgcatttttaaatgagcagtttttatcaaactatatgttttcagacaataatttatagattactcttgtaagttttcgtactgagtggtcctgggcacatctgtggaatttaccttacagtcgttttagtttataatatttattgaaagtgagattgtacttgcagactggcagaatgcattgatatagctttttcttaatagcgcgaaccacgttttgactgtgctgttcgagaaattgactgataagtaccggggtctatacctacaaattctataactttgacagtagagctgaagttatggatatcgctagtctcatctaaatttgtcaacatcgatatcagtgtaaaatatggaaaacacatcctttctttatataaggtaatgaaatgtgatcaaaccacaaacagagtatcaaagacctgatgcgaaatacaagttcaaaaacttatctaactgattacaattaagatacaaagatgtggtattaaccttttccaggtagtcgggctacagaaggcaaaaacaaaagtacctattcacaattcgattctaaatgaaatctaatgaaaggaagaggtgtatacaattgacggttaaataagttaattacaatataccagaagtcaaaatatgaaaacattatatatgatgcgtcatggacaaacgttatttaatcaaaaaaggttaatgcaggggtggtgtgattcacctttgacagaactgggaaaaagacaagcaagatgtgtaaaagagtatttggagaataatgagattgtttttgatggtgcttatgcatcatcttcagaaagagcttgtgatactctagaaattgtaactagcctcccatatcagcggcttaaaggtttaaaagaatggaattttggtatttatgaaggagaaagcgatgatcttgatcccccttttccatttggcgatttctttaagaaatttggtggtgaaagtgaaaatgaagtaagtgaacgtgtttcaacaactgttttagaacttatgaaaaatactgatcaagaaacagtgttaatagtctcacatggtctttcttgctattgttttgcgaaaagatgggaacaaaatcagcaagtatcgctacctaatgatatgcccaattgtgttgttttaaagtatcaatttaatgatgagcaattttcattagttgaagtcattgatgtaactagtgaattaaagtaaaaaagtctagatatagaaattaatctatatttagactttttaatcaccaaatgagatacctagtaacttagcgtctttaacttttgctcctacagcatcaacatattttagtttaccagcactttcaactaagggaatagcagtaactccattattttttaagataactaatttgccataatctccgcccataactaaacgggctccagctaccccaaattgagttgagatcattcgatcgtatggacatggctgtcctccgcgctgggcatgaccaatacatgacacacgaatttcgctatcaatatatttttctaattctgctgcaatctcgtaaacaactgattgaccattgcgggctttaactttagctttatactctttttttgatagtgttgcttcttctttggataaagcgccttccgcacaagcgataatactgaattttttcccatttttttctctagttttaatagccttagctacttctttaatatcgtaaggaatttctggtaacaaaattacatcagcgcctgaagcaattcctgctgacaaacaaatatggccaactttatgtcccattacttcaattacaaaaacacggttgtggctggcagcggtagtatgaatttgatcaaggtatgtggttgcaatatcaattgcagactgatagccaaaagtataatcagttccccatgtatcattatcgattgttttaggtagcgctataacattcaatccttcttgagagagcatgttagctgattttatagaaccatttccgcctagcacaacaagacaatctaattttaattttgcatatgtgtttttcattgcagctactttgtcaaagtcatcttcaattactcgcatttttttaaaaggacaacgtgatgttcctaaaattgtcccaccaatattaattattccagaaaaatccttgggcttcataattttataatcttcatacattaaccctttatagccttgaagaaagccaataatttctatatcgtttacatttcgatataaagtttttgctagaccacgcattgttacatttagtgcttggcaatcaccaccacttgttaaaatacctacccgcatataatcactcctttattatttatattgccaattatttgaaaaaatattcctgactattcaattctggctctttattttttactcgtttgtaagtaccatcttctaataagcggcatgctttaacattatctttcaacattgtattaaacattgtaataattcgttttcttaatttttcatctaaaattggggcagcgacttcaacacgacgtgataaatttcttgtcattaaatcagcagaagaaatgtatactttttgagcactgcctttaccaaagatgtaaatacgtgaatgttccaagtacctaccaacaatagaaattattctaatattatcagttaatccctcaacaccaggtaaaatacaacatataccacgaacaatcatatcaattttgacccctgcctggcttgcttcgattagcttatcgatcatttctttactagtgacggaattgcatttaaatccaatataagcttctttacccgctttggctaaagcaatttgattatcaatatgttcaaatatttttgtaatcatacagttaggagcaaccattaaaagattaacttcattttctgtttcgccaagacatagatgattaaaaatgctgttgatttcttccccaatttcgtagttagatgtcattagtgataaatcagtataaagctttgatgtattttcattatagtttcctgttcccacctggctaatataatgaacaccctgattatttttataagttattaaacataattttgagtgaactttaagtccatctaaaccatagataacacggcatccagattcttcaagtcgttttgaccagtcaatgttattttcttcatcaaaacgtgctcgtaattcaactaaaacaacaacttctttaccgttttcagcagcttcaatcaatgatttaataatcttagatttctttgcaacacgatataaagtcattttaatactggcaacatttgtatctcgactagcctcatctaataaacggagaaaaggtgacatcgactcatatggatatgataataaaatatctttttttaaaatttgtttgatcattggaacagtattttcaactaaaggactgtttttagcttctaattttttatagaacatttctgggtgaatgtagcgtaaatgatcacgtaactcactagtgaatttcaaatctaatggagcattacactcgaaaacctgatgttttttgaggttcaagaagttcattaacatcaagatttctaactcttctaagcctggtgatacttccaaacgaataggacataattttctacgttgtttaattaatgtttccatcatttctcgatagtcttcatgaccttctaaagagtgatcatcttcatcaatatcagcacttcttgtaactctgatgaaacctttattttttattgtatatttagagaagatattagaaataaaatgcaggatgatatcttcaatcaaaataaacttcccttgcatactaggaatcgcaatcattcgttcatccatagcatttgcacaagaaacgattcccatctttctttttcccttctttgattctaactgaacaacaacataaacttcacggttatttaaaaaagggaatggttgacgttttgaaataacctggggagagattaatggaagaatttctcgttcaaaataactttcaaaatatttacgatcttctttgttctttaaatcacggtattttacgattccccatccatgagtttttaattcatccataatactttgataaatacgatctttctttttatttaaataagtaattcttcgtaaacatgcctttagctgttcttcaccagtcattccagttttattgtctttagaactaggatagaatagcatttgatcatataatgatccaattctaaccataaaaaattcatcaagatttgattgaaaaatagaaataaaacttaacttttcacctaaagggactttattatctttagcctgcattaatactcgatcattaaatttaagccaagataattcacgattttctttacatttattcattgaaatggcgcctcctattttgtttctaaaaataacataatatttattaaaaaaattatcaagtaaagtcggattacttacaaaactcttacgcaaatttaacgtttctttaatattagtatagcacttttgattttagtattcatcaaaaccataaatatgtaaaatgatttaaatcattcaaaagaaaaaggtgttgtcaaaacacctaaaaatattacgattctatttagatttattatttagtaattgctgatagatcatttcatcgtcctctttgaaaacgttaaaaataactttttcaatctgacttcctttaagaaatgtggatactgtattgactgcaatttgagctgcttcttttttaggaaagttaaatactcctgtagagatacaacaaaaagcaatactttttaatccataagcctcagctttttttaaacaattacgataacattcagctaataaaaagcgcttttcatctgttagtacattatgaacgataggaccaactgtatggacgatataacgacaaggaagattataagcattagttatttttgcttttccggtgggctcaagataacgctgtttagacatgatttggtgacattcatttcttaattgaactcctgcaaaggtatggatagcattgtcgatacaattatgtccagggataaagcatccttccatttgattattggcagcatttacaatggcatcaacttttagttgggtgatatcaccacgccagatattcattgattttttgaaattgcttgagtcaatgattccttttcgtttaatttcattttttaacattttgttttgaatcataatgaatttgtcagtagctgtttttgcttcacgaatatttactaatgagcgataaagggaaaatagttgtgcttgttctgtaggaagttcaatttcaagtttattttcttgaattaaatagttaattaaaaattgtaatcgggttatttgattcatagcaatttctccaaagacgataagacattatgaatgttatcgttgatcatgatagtctgtttttttaattccgaaggtaaatcaataatatcttgattgatgcaggcataaatagctttaggattctctatagttaattgccaaaatggatatttgataattccaggggtattatagccaactcctaattctaaataaacgattttggaataatgatgtttatttaaaaagtgataataacgttcttgggcatgataccagccggaatcttgaacaaatgttttatcacagcgaagattcattgtcattggagcattacatattggacagtacggaattagtgaactgggaattttcaaatcatgctgttgtttgatcattgtaacaactgtctcgtaattatcataagttttttgatggcatggttttgaacattgccaaagtccgtaatctccttgagtataaaataatttttctttaataaaaccagctatttgaaactgatgatcaacatttgttgtaatgacgaaataatctttattaatgagtaggtttaataattttttataagtatctttaggggcttccaaatagcggttataataaatatgacgactccaataagcccagtatttctctaaactaggataggggtaaaagcctgccgaatacatatcttgtaaatgatattttgtaatgaaatcattaaaatattttttaaaacggttccctgagtatgacagaccagcggcgctagaaagtccagctccagctccaattaagattgcatcacattttttgattgcttgactcaattttaaaatatcaagtgattctctttgaaacattataacactcccttctcatcgttattatccttcaatggttgctatttgtgaagtacgcacataaaagtggcttagtttcttttatgtaactaacttgactttcataagtatagtttataaaatatacttagttactataagaaactataaggagtacacatatgaaagaatttccaaaatgtccagttgaaactacattattattaataagtgataaatggaaggttttgattattagggatctgctaccagggaaaaaaagatttggtgagttaaaaaaatcaatcggaacgatttctcaaaaagtattaacttcaaaccttcgggcaatggaggagagtggattgattagtcgtaaagtttatcccgaagttcctcctaaagtcgaatattcgctaactgagttaggttatagtttaaaaccaatcttggatgctatgtatagctggggtgaagattttaagaaaaatcatcaatcaatataataatggatagagtctcagtgttaatattttttggatggctgaatgatcttaaagggggttcagtaaaaaatagaaattgataaaaatacgactcataaagatataaagtgtcaaatttctagtttcttaacaagtataatagtgcatgataataacttatgactagagagttagaggggaaaattatggataatgaagatttagtaagagaatatagcaataatcttacaacatatgaacaatttacaaatttgatggaaacatatatatgtaatttgttgaatcgtgaacaaatatcgtttcattcaatcactagtagaacaaagagtattgagagtttatctaaaaagatagagttaaaaaacaagtatcaaaaattagatgaaataacagatttatcaggtattagggtaattacatattatacggatactgttgatcaaatatcgaaattaattgaaaatgagtttattattgatcgtgataattctattgataaaagaaagagtctggatccaaaacgttttgggtatcgttcgttgcattatgtggttcaaattgatcctaagtatgttaaagcacaggaatatcttaagtatcataatttaaaattagaaattcaaattagctcaattctgcaatacacatgggctgagattgaacatgatttaggttataaatctcaagaagagattccctatgatattaaaaggagtttttcacggttagctggattgttagaattggcagatgaggaatttttaagaattaaaaatgagatctttgcatatcaaaatcatttgctgctttcttatttaagtgctgatattgataaagaatcattagctgtatttaaagtcaaaagtcctgaatataatgaattgacagaatttttaattaaagaaatgaaagctaagaaggttagtcagggtaattttgagaatatcattaggatgtttgagtatttgaatataagtaaacttcaggaggtagatcaaaaattaaagcaatatcaacagctgataatggaacacattgatgttctttatcgtgatgcaacaaggactaaaacaaatataatttctggtgatatgccattgttatgtttatgctattttattttagtagtagagaaaggtgaagtggagtttgagaagttcacagaacagtttatttctagtgttaattttaaaaatcgattaatagaattaaaaagaatattgaaagattataaattagaagctgctgattaaattaacagctatttaaactagagttagctctagtttttttataatgtttaaagtatttataataatggatataaatgtaattgtgatcagtcttacgagtttgctaggggctttttataagttatttagaacttacaagatattataatgataacgcttgctttttctgaggaaaaagatgtttataataatatttatggtataattatgatgttagtattattaattgtttcgtttatattgggctatagtttaggatttgaggaggaataataaaatgaaaaactggtggcaaaagagtgttgtgtatgaaatatatgtgcggagttttaaagataccaatcatgatgggatcggtgatattaatgggattactgagcagttagattatttagcaacattgggagttgatgtgttgtggatcacgccaatttatgaatcgccaaatgatgataatggatatgatatctcagactactatgagataatgcaatgttttggaaatatgactgattttgagaatcttttaacgcaagctcataagcgaaatattaagatagttatggatcttgttgttaatcatacctctgatgaacatagatggtttatcgaaagtaagaaaagtaaagataatccatatcgtgattattatatttggaaagatggtaaagaagatggcagtgtaccaaataattggacaagttgttttctaggttcagcttggcagtatgatgagacaacgaaacagtattatttacatttattttctaaaaaacaaccggatttaaattgggataatactgatgttagaaatgaaattcaaaaaatgattgcctggtggcttgataaaggaattgatggatttagaatggatgtcattaatttgatttctaaagatcaagataatatttatcaagatagtccaataaaggggcatagtgtcagtgctaatggacctcgtgtccatgaatatattcgtgagttaacagataacgttttttcaaaatatgatgtgatgactgttggagaagctccagcagtgacaacaaaagaagctattcaatatgcaagtaatgatggaaaagaaatgagtatggtttttcaatttgaattaatggatgttgatggtggtgaaaaacaaaaatggagtgatgaaagatttaaattaacggatgtaaaagcaattttaagaaaatggcaaattgatatgcatggacgagcatggaattcgttattttggaataatcatgatcaaccacgagtagttagtcgttttggagatacaagttctaaagaaacttgggaaaaatcagcaaaaatgcttgctactgcccaatattttttacaagggactccttatatttatcaaggtgaagaacttggaatgactaatgttgagtttaagaatattggtgagcttagagatattgaaagtataaattcttatcatcagtatgttgaagtggaaaaaatgtttacccctgaagagatgcttcgatttattaataaatcaagtcgtgatcatgcacgtactccaatgcaatggaatgatctagaaaatgcaggattctctgatgctgaaccatggatcaaagttaatcaaaattataaatggcttaatgcacaagcacaaataactgatgaaaactcaatttttaattactataaaaaaatgatctcaattttaaaggaaaatgaagttgttcagtttggtgattatcaagaatattatgaggatagtaatgaagtctatgtttataaacgggagtatgacggaaaaaaattatttgtcttatctaattttacagctaaagaggttacctatgataaaactttatttgaagctgaagcaaaggtgttactaggaaattataatgatttgataagagggaaattacgggcttatgaagcggttgtactagttgtttaaagttagtattagggatgatcttgaatgatcaggaggtaagaaaatgcctaaaaaatattttaagattggttgcactgtaattatagtaactttaataggattatttttaaaaaataatgctccggctaataattataaaaatcccgatactttgaatatacaagataaacaaagtatgatgatggcagataaggctgttgaaaaaatagctaggggaacatccgggaagtttgaaactttatatttaggggctgatggtcaatttcaatggaatattttaaatccggaagaaactagcttttttgatgaagatggaaaagctattaaatccattttattaatttcaacaaagcttcaaacctcaacaccatttgatcaggaaagtaatcgctatgaaactagtactttacgacaagcagagattgcgttagcatctcaaactttatcaccaaaagaagcggaagtaatatttaatactactcaaccaggtggtgacgttgttactgttactagttattcatttatagaatcacagttatttggtgataaattttttgccccaacagcaaaaataatgaattcaaatagttgtggacttgaagatcgtcattatcgtcaggaggggaattattactggttgtcagcagctgctaaagatgatcctaaattagcgggatatatctctaaatgtggagtttttgcacaattagatattactgtcgagcatcttagtgcaagagctactgctaatcttgatcctcatgcagttttattttttgctgcagcccaaggtggtaaagtcagtggagtagtcgggagcaaagcaatgcaggacgtggaacatcaagaattacttagtgattatcgtttaacattaaaagatgcttcacaaaccttagttgtgagcgatcaggttaaagaaaataataaaataagttttaattataatgcccaaggcgatggggatttactcagtgcagttataattgataaaacacaaaatgagattgtatcttatggtcagttagctgatattagtgttactaaaatgggtgttgctttaattgagttgccaaaaaaatatgatcatgataactatcagataaaagtgtttagtgagcaatataacggggactacaaaacggattatgccagtgaattagttgatttgaagattgaataaaataaaaagagctggatttaactgtaccgacctcctaaccgttagaatttgatatgtatctaaaattcagggcacatatcatttttgatctaactttctgaggtcacatcaaacgatttgttaaatctagttcttttttattaaatacttttgctgcgttcattggctttatgaactttacaaggattgccataagcaattgtatcagcagggatatcttttgtaacaacactacctgctccaattacggtattatcaccaattgtaactcccggtagaataattgttcccccgccaatccaaacatttttaccaataataactggggctgtttgtgttttacaaaaattgaatgtttcattttcactgatagtaaaacgatcaagataatgagtaggatgataagcggtatatatttgtacatttggagcaattaaaacattatcaccaataataattttattatcatcgagaaatgtacaattcatattaacttcgcagttattcccaaaatatatattacagccataatcaacatgaaaaggtggggtaatccataattggtttccaactttacctaataattcattaagaagctcactttttcttttggtatcgctagaattggttagattataatctcgggctagatctttggctcgatgccatagagcaagtaattcggcatcgccacaatcatataattccccagctaacattttttctttttcagtcatttaagataataactttaatagatcaagtggctgctcaaacacgtgatctggtttatcaatacctttagcggaaacacttccccattttgcataaccaaagtcgataccagcgtttttagatgcgagataatcagaatgagcatcaccgatataaataacatcttcaggttgcaaagataatcgctttaaacattctaataacggttcgggatcgggtttatgcttgactgtatcgttagctaaaacagcagttttcatatatttatctaaaccttttgcaacaaaatcaatttgatactgtgctgttgtttttgctgaagcaactgcttgaatgatgcttccgtcaaatgcttcaaaaatttcttcaaaccctgggtataaagaagcgccttcttcatattcattgacatatttaacccatctagcgtaagccttttctttatcagctacttgtaactcttccattactttcatacctggatagggtaaaaattttaagacttgttcaaatgtccaatcttcaccagtttcttctttaataatcttaatcaagggatacatattcatatttattgtatttaatactgttccgtcaaggtcataaataattgctttatattttttcattactttcctccactaattgttttaatattttttcaattcctaaataatttaacccatggaataagttatctaaatattgtttataaactttaatatcataaataaattgtgagtgtagataagtataaatagtttcattaattaaatgccaatccaagtcccaatcaagttcaagagaaaggtcaacatgctcagggtctaaagacgttaaaacaattattaatagataagcaataatgttttgaaagtcttttggcttgttacatgtcctaactgcttgatttaaggaaatatcgtgataaggaataagtcctatttcaccagcaattccatatttgccatgaactaattgtccattatacatatatgaactaccaattccctttttgtttaggtgcaaataaattgaactatttttatgatgatgataacaagtacctaattgcatcgctttgacatcgttttcaactagaataggaatattgatactcttttctaactctgtgatccaagtgtgggtttcaaagtggttattgtggtcggttaaatattcattatctctaacgattccttcaactgcaataacgatacattgacaattgaatttggtgagaagcactttaattagagtaattaattgttgttcatcctcaaattccagaatatcggttgttagtatttttttgtaagaatgaatttgataagttattttagggttttgaatatagagacagattatattaaaatgcttttcaactaatgcaaagcgggttgggcaacgtccaccggttgaatgatcgttacctgtttctttaacaatatcgtgttgttgcaaaaggcgaatcatatttcttacactaggctgtgataattgagtatcattgctcaattcgctcattgtggcactgtctctactaaataatgattgtaataatagatgtaagtgatgtttttttacatctttaagaatttttttggtcatgtgtgcctcctacttttattatactttaataaaagttatttacaagctaataataaaaaataaatatatttttaaaaatggaaagattttatctgctggtttatattttatggaaatttatgctagaattaaagataataagttaaactattaataatatggggagaaaaaaatgaaaggatttaaacgaaataatcaattattatctttgtgcggtttgaactgtggtttgtgtccgatgcatattgatggttactgtccaggatgtggtggtggagcaggaaatcaaagttgtaggattgctcgttgtagtttggaacatgataatctcacatattgttatgaatgttcatcatatccttgtgataaatacatgaaatttgctaaatatgattcatttattacacatcaacattatcatcaagatttaatgaaagctaaagatggtggtatagacacatataatcaagagcagcttgaaaagatagatattttaaaaatatttttagaaaaatataatgatggacgaaaaaagagtttttattgtcttgctgtaaatcttttagagttagaagaacttaaaagtctaattaaacagatagaaactaattcaaagctgtcagctctaacaaaaaaagagcaagctaaatatgtatttgatttatttcaagatttagccaaacaacatagcttaatcttgaaattaaataagaagagtaaaaaataatttacccgtaagattagcaagagtaactaatttacgggtatttttattgtacaatcgaagcatcatattgaattgtttgtaataaagctttacaagtattaataaattcatccttattcatgcctttaacaattgcttcactagctagtaactctagctcatcaagtaatttttcttgatgttcatgagaattatcaatcgttggttgaactttagcaccatgacggcgatcaatacaaatatagccttcttgttttagcagcccataagctttattaacggtcatattatttacttgaagatcttgagctaaagtcctaacggttggtaatgactcgccgtatttaaattgaccgttagcaatacctttaacaatttcattacgtagttgcaaataaattggaatttcacttgtatagtctagattaataatcattggcaaagcacctcctgaatttcttgatagatgagtttagtattttgaatatcatcatcattaacgatataggttatatcatcagtatacaaaattatatagcaaggatgcaaacttgccatgtatactttacacttaccataacggtcaaaagtataatttcccttaccataaacaaaagtatcggttccattagttctaattcctttacctaaatcatcggctaattctgctttattaactttttgaagatcaattgaaacatcgtagaaaggactatcaacaactactgcttgatcggttaaagaaagattgacaagattattagttatatctaaataatacggatatccaaataaccatagcaataaagcaataacaaatgtccaaataccaataataaaaattcgataagccggttttgcagtattaaatgtcatctgtgttccatttggtgctgaaataagtgtacgtggatcagctttattataatacgttggaccaaaccaaccgattttccagcaatcatcattactgatggtatattcacattcgttgtaatgagcgagaatctttgcctttttctctcgataatggttagctttaatgacaatgataattacacaaagaatcattattaaggcaactaaaaagagtattacaaaaggtagcttttcaagtaagaaaaattgtaaagctaagttaaaaatactatcaccagtgattaaaaagaaaaaacaatgatgaaaagaatcacgacgtagtaaattcaatgttatatttacttcactgtttttacagaatgttttatttggtaattttttaataaagacaattccaagtactaagaccataaattgtaataccatgtaaagatacatggcattttcagcgtggaaataaatcatatttcctaatacagatagatcaattattaaaacgaagaagtaacgtcttaaattaaaagggtgtttttccatataggctgataatgataaatcaattttaattttctctattttttcatctggccaattgcgcaatttttttaaagctaataatttagcacgtgcttttctatacggaacataatagacggaaacgttaaaccatatcacaatcataaaataaagtaatagccatttagttgaaaaaataaataaaggaataaatgttataaatgagataataaatacccataaatgttcttttttaaactgtttctcaatttctttaatttcaacagattcataagcccaatcagggattgtaactaaaaataagcgtccttcattataacgactctctcgtttagaagaaaagtacattactacattaataaaaactaaacataaaattaaaatccacatattactcacctcttatatttgtattatataacataatacaaataatacaaaataaaataataaaatattataacatattttgctgaaaaagattcgcaacaaaaagcagaattgattcgattctgccaggttgataattattcagctgtttctaaaccttgttttttagcagctttattagaagctgatacaagtggtgcataaactaagagtccaattatggttataacgatctgtgagggcgtaccccgtatatcaccagtagatagataaccagaaagtaaggggggagttacccatgggataacaatataagtatgtcctactaagccaactgcagttgcaaaatatgctattaaaggtgaaacaaatagaaacaatacagaaaggaacagtataaatagggttgaaaacgacaggaagtccaaacataattggttcactgatattgaagatacttgagacctcacccaaacgggcaatcactttttcttgaaaagataaatacggtaacaactaagattaataaaatcattaagaaaaatgaaacttttgtaagtcagtataatgatgattttaaagatgcggttcgtttcagtgttattgattatggcgcaacagtaggaacagctaaaaagatggaaacaaaattttctgaaacaattagggttgcaagtcaaggttataagttagaggcttatatgcatggaccatatttggaagtcaatccagaacatcgaattttctttagcgaaacgctaagtccaagattatctaaagcaaaactattaaaagcctatgaatcacagtatacggagcacgtgtttgctattacgaaagcacaatcaataagaccttagcattagatattgctttagatgagtatcaggctgcatatttactaattattcttttccaagtaatgacgtggtgtattgctaaaagtaaagaaattgatttgacgaaatggatttatacagatttttctcaagcggtcaagagtaaaacggctgtttaagattatgtctagaaaggcttgtcaaaaatatttgacaacattcctaatatctttggtagcattattttgatggtttatttatactattaattataggaggaaagcagatgttaggcgaaaaattaatgcgattaagaaaaaaacagggctatagtcaacaagaggttgcagataagttatcagtgagtagacaaactatttctaactgggaatgtgatcaagccttacccgcagttgataaagccatggaattggcacagttatataatataagtttagatgatttaatggaaaatgagattgaaatagttagtaataataaaactaaagacctacatcttttacaatatttgatcggaaaaacttgtacgctggagtgcacacgagatgcctatttgttagatatatctacaagtgatggaaaggttctaattgttgatgtcaatgatgattgggttaaagtgcagtatcatcgaacaaaaaaaggttcgtttataaaaaaagaaactgttaccaaactaattgatctatcatgtattagcggctttaaggtcgagggggaattataatgacgactattattgcaattattgctttagttataagtatttgtgcaatatatgagattgaaaaactaaagaaaaatgatgttaaaaatattgaaaaagaaattaaggaaacagatcgaattaagaatattttagcaggattaaagcagtgtgattgcgaattgattgtaaaagaaaccatgtttttgattgatgtcccatatagtgtagaaggtaaaatcattgatttagatgatgattgggttttaattgttagtatgggaagaaagacgattagtagaatgattaggataaccatgattaaagatgtaatagaattgactaagtagacaactaaggttgtctttttaaatgtaaactaattttaaataattagtttacaatttagtgaatgtttgctatgcttaaaaacgaggtgattcaatgagtgtaaaacaaaatgtaattgctttacttgaagaaaatcgtagtaaggtaatatccggacaagagttagccaaccaattgcatgttagtcgtgcggcaatttggaaagcgataaagacattaaaagaagagggatataatattgaagcaacgccaaataaaggatatgtattattagaaaatagtgatgttttatcaaaacaaggaattgcatattatttaactgaagaaattgatatcttttcatataaaacaatcgattcaaccaatacacaaatgaagaaattagcaataaatggtggtaaaaatcatagtgtaattgtgtctgaagaacaaagcgccggacgtggtagatttggacgaagtttttattcaccggctcaaaaaggggtttatatgagtgttttattaaaaacaggagattcgctacaaaatgcaactatgattacaattaaaacagcagttgcggttaggcgagcaattgcaaagctatatgatattgaagtagcaattaagtgggttaatgatttgtattatcgagggaagaaggtttgtggtattttaagtgaggcaattagtgattttgaaagcggaatgatcgaagcaattattattggaattggaattaatgtatcaactgataattttccattagaaatagcttccatagctacttctctaggattacaagaagctaatcgtaatcaatttattgcagaaatcttaaatcagctatttgcaattatcgatgaggattttaaattggttttgaatgaatatcgcatggcttcatgtgtattgcataagcaaataacttttaatcaaaagggggaacagtttaccggtttagttcgtgaaattaatgatttaggtaatttggtcgttagtagcaatggtgcagaaatggtattaaccgcgggtgaagtaagtattataggaggaaaccatggagcagaataagttactaacaacaaagaaaataacctattgtgcaatttttacggctctaattacaatcggagcatttatacagattccggtacctttcatggattattttacattacaatttttctttgttttgctagctggaattttattaggctcaaaattaggagcattggcagtattactgtatgttgtaattggattactaggattaccaatatttgcggccggtggaggtttagcgtatattgttagacctagttttggttatttaattggttttattgcaggagcgtatgttacaggcataatatgtgaaaaaactaatgaaatagcagcaaaaaaatatgttttggcagtattgagtggtcttttggccacttatatgattggacttggctataaatatatcattttgaattactatactggaactccaataacttggaaactagttttgctctcatgttttcctttagatttaccaggtgacttatttttaagttttttagcagtcgggacaggaattagatttgaaaagatttttaaaaagaggagaatacaatgttagagaagctcattgcacaaattatggctggttatgaaattagtaaagcagaagctaagatgctgatagattatgatctagggactttaaagcaaggggctgaactaattagaagaagctattgtggtagtacatttgatctttgttcaattattaatggtaaaagcgggcggtgtagtgagaattgtaaatattgtgctcaatcagtttattatcaaactggaattgatatttatagtttgttgaaaattagtgaaattaaagcaatagccctacataatcaaaagcaaggtgtcgaacgtttttctattgtgacatccggacggaaattaaatgttcaagaatttaataaaattttaaaaatatatcaagaacttaatgatactacaacgatatccttatgtgcttcactaggactattaaactttgaagagttaaaaaaacttaaagaaacaggcgttaaaagatatcataataatttggaaacatcacgtaactactttaataatgtttgtactactcatagttacgagcaaaaaatcaaaacaattaaggctgcaaaattagcaggtttggaggtttgtagtggcggaattgtaggaatgggagaatcatggcttgatcgacttgatctagcttttgaattaaaagacttaggaataaagtcggttccaatcaatgttctaaatccaattagaggaacaccgttagaacatttgaaaccattatcaaaagaagatgttgaaagaatatttgccatttttcgttttattcttcctgatgcaacgattagaatggctggtggtagagggctttttgatgataaaggaataaatgtatttaaaagtggtgctaatggcgctatcactggagatatgcttacaactcagggaataactattgctgaagatcaaagaatcattaagcaattgggatttagggtagccaagccatgattaaaggtttgtttgttactggaacagggacagatgttggaaagacatatgtaagtgcaagaatagttaaagccttgaaatcacagtataaggttggttattataaggcggccttaagtggtgccgttgttgaaaatgatgtactgataccaggtgatttagaagttgttaagcagtatgcaagtctgccaaatgaaagctgtaaagtatcttttgtttatgaagaagcatttgcgcctcatctagctgcaaaaaagactaatacaccagttgatttaaatactataaaagcagatttgacagatttagaaaataagcatgattttgttgttattgaaggaagtggtggtattgtttgtccactgcgcgatgataaattgataatgcttagtgatgtgatgttactggctaactatccgctaataattgtaacatcatcaggcttgggtagtattaatggagcagttttaacggctcaatatgctaaacagttaaatttaaatgtacttggttttattatgaataattttgatagtaacaatctccttcatcaagataatcgaataatgattgaaagattaagtagttataaagttttagggtatttaaacaaaaaagctgataagattgaatggtttgaacaaattatagaaagttaagataaaaaagtgaaatatacctcggtatttaatacttaatatctaataaacgggagatatttcaaattcacttttaattataaataatcggttcctatctactttagcggagttatatcaatatgtagttacagtttttttcatgttaacattattggcgaaatgttaacggattgatatagacgaaaaaagacaaaatatctatgatatagataggagggatgggttatgagcattggtaaaaaactactaagcctaaggcaagaaaaagggatttcacaagaagctttgggccgtgaattaaatgtatcaaggcaaacagtgtctaaatgggaaagtgatttaagtttaccagacatgaaaatgatgataacaataagtcaattttatgaaataagtattacccaattattagatcttgatgatgaaacagaagctgattcaatcaataagatatatgaacaaacatcattagtgttagagaatctacaaaaggaaaataaaaaaaagattattcgtgattggataattattattatttgtactctttgtttatgtgttgcattagcaatactagttaaaaagggaactaatgaggtagttttttatcctaataatagtacaactccaataaccgataacaatataatagattattcaaatacaacatttaaagtgattagttatgactttgataaaatgacaatgagtattaattataaatgcgttttaaataattatacagatataactcaagtaaatatctgtattgttgatgtttttaataatcagagtatttatccaatgactaaagaaaatgcttatacttttgttttaacagaaacaattcctttagtgaattatgctaactttgaaattttggttaaaaatggtgataaaggagaaaaaattaatgcggattcagaaatagaacatcatttagacaacttgttgagacacttgatttatatctatattccaggtgataaaaattataaattgattagaaataatatgatttataaattagattatagttatttagaaaacgaaaagattgattatagtggtactttatcaaataaagtagagataattattaataaaattaaaaataataattatgaaaaaattggtcaaactaatacaactttagataagcaaaaaaagataaaattatcaaaagacttatctaatggtagtgagataaatgttatcgtaaatataataaccgctgagcaatcatatgaattggttaatattaaccgttatgttcaaactggaggaattagttattctgagtatcctatctatcgttatggagatatttaaaaaaagatcgtaatgatcttttttactattttatttcaatgagttcgtattcacgagttccgattccaattttttcaccatgttctaaacaagatttccagtttgtttcaggtgatacgtctgtaaagtgatcatgatgatgatgaccatgtttatctaacaaactatttgcaatagcaggctgtttattaacagcatcagcacaagccatatctaaagcaacgggatcaaatgaggcaaacattccgacatcagggacgatggcaatatcattttcactatgacaatcacaataaggtgatacatcaataaccaatgaaatatgaaaacatggtcgatcttgcacaactgctttagtatattcagcaatcttatagtttaaaatgtcattagcttcatccatgctggcaacgattgcatctttaggacagactccaatacagcgaccgcatccaacacatttatcatgatcgatagaggctttgtgatcagtaatacttgtcccgttatgagcacaaattttaatacattgtccacagccaatacacttatcttgctcaacgacaggtttgccagcactgtgcatttccattttaccagcacgggaaccacatcccatacctaaatttttcaaagcaccaccaaatccagtcaattcgtgtcctttaaagtgatttaacgaaatgataatatcagcatccataatcgcttgaccaatttttgcttctttaacatattctccattgattggaacgatttcttcatctgttccttttaaaccatcagcaatgattgtgtgaactccggtttggaaaggattgtagccattagaataagcactgtctaaatgatctagtgcattttttcttcctcccacatatagagtattacaatcagttacgaaagcttttccacccaattcttttacatagtcagcaacagctttagcgtaatttgggcgtaaaaaagctaaattaccgggttctccgaaatgtactttgatagcagtgtatttgtttttaaagtcaatttcttcaaaacctgctttcttcattaaaaacttcagtttttcaggaagattcattcttcctgtatgcatatcacaataataaacttttgctttttccataattacctccatgatattatgtccttgtataatttaattttagcactatttattgtaggctaaaagctaaatcaattatatcttacatcttaaagtatgctttaacgcaatataaatagcaaataattacaacaaaaaaagagcatctcaaatataaatcgagatgttcctttaaataaattattaattattttcctcagcagtatcattagtcaaattgaatttatctaataagtagaaagttagtgaaagaatcatagcaacaatacaagctagcaccattccagttaattcgacaccaccaaagcttagcgtaatactgcttaatcctgtaacaaaaacaactgaagttaagataaggtttttattagttgcgtaatcaactttttgatcaactaaaattcttaatccactagtaccaatcattccatatagtaagaaactgattccaccaataaccggtccaggaatagtttgaattagtgctgataagggtcctacgaatgaacaaataatagaaagaacagctgcacctgcaattacttgaacactatatacaccggtgatagccataaccccaatattttcaccatatgtagttgttggaacagaaccgataaatcctgaaatcatagttgaaaaattatcaccaaataaagaacgatgtaatccagggtcttctaacaggtttttaccgattatttttcctgtaacaatttgatgaccgatatgttctgaagtaattacaagaagaactggtaagatcatcaagatagcgttaatatcaaattttggagttgagaaattaggtattgcaaatagtggagcatttgctacagttgtaaaatctactaatccaaaacaaattgctgcaatatatccacagataattgcaataagaattggaatgacacttaaaaattttctaaaacaaatatttccaaaaattgcaactcctagagtaattaaaaatatccaaacattggccatctgaatattatcaccaatcaagcctgcattatttgcagcagtagcacttaattctaatccaattaatgcaactactggtcccattgcagctggtggtaaaacaatatcgatccattttgtcccacattttttaataattaaggctaataaacagccgcaaaatccgactgctacgaatccccccaaagcataagggtagccaaatttagaaatgacaatatttgctggagcaataaaagcgaagctagaacctagataggcaggggctttcccttttgtaataacaataaataataacgttccaataccgttcatgaataagacgatagctggatttatcccaaataagaaaggtactaaaacactggcaccaaacattgcaaacatatgttgtaatgataatggaatcagtaattttcctgggactttatcctcaacttgaataatccgtttattagacatacatgtcctcctttttaaccttaaatattatgtcattatttagtgatactgtctataaaaatcttcttattttagtttaaaaaatttaattgttcaaatatttgattatttcctttatcgcttggttgaacaatatgttaaaatgatggtgcaggaggtaaaactatgcaattagaagaactggtaaatcagtattatgatgatttaaatgaaaatgatttaatgatttggaaatatatattagcccataaaaaagagtgctgtgaaatatctattgatgaattatctaaacgttgtaacatatcacgggcaacaatttcaagatttagccaaaagatatcttttgagggatttcgtgaatttaagatgcgtttaaaattagaatgtcagcaggttcaagtaaagaatgatggaatgcttgatgaaatttgtaataattatctaaaaagtatggaactaactaaagatagcgatcttgatgacctctttgaacatatacatcacgcacgtaggctctttgtctttggaactggtgagacacaaaatacagtagccgaaatgattaaaagagtttttcttcaaactaaagtatttttcgtcaccttatatggtaaaagtgaattaaagatgactattaatggtttaggagaacaggatgtaatgatttttatttctgtatctggtgaaaatgaaatggcaattgaggcaatgaaaacattgaaaaataaaggtacttatattgtttctatcactaaactaaataataatacactagcgcggcttgctgataaaagtttgtatgtaattacagatcaatacaaaagatttaataatcgtacctatgaaacgacttcagcatattttaatacagtagaaattttatttcttaaatatctagattatctggataatttagatgagtaaaatatttctgcacaattttaagtttgagaacccttgaagtttaattttaagggttttttattaatatttactgtacttatgcacagatcttgtgcaaaggatataaatgtgaacctcttctttaaatacgcttaagatgttgaatcaaaaattatttatattacaataaaggtacattaagatcttagtgcagcaaaaaataaattaactctcttgggggtcatggaatataaatatatatttagcgcgaatgttatttatattgaatgcatagagggtttctaaaacttattaatccatgaaacagaggagaaaaagaaaatggaaaagaaatattcagttgttattgctggtggtggaagtactttcacacctgggataaaacaaaaaaaggtgataatcatctgtagtgattaatcaccccgtggacaaaatttattttgtcccttttttatttaaaaataagtgtatgattttccaaattgaaaagggttacaaaataatatgctatgatatttttgtaatcagggaaagacatgtcggtgattaataaaattaaaagaagagggcagaagaaatggaattatctaaattaacaagtgagcagcttattactttaaatagtgatttgtcatcaaaagatgaaataattaaattcttagtttctaaattatatcaggcaggaaaaattagtaatgaggaagatttttatcaagcagtattagaacgtgaaagcttaacaccaacagggattgataatggtctggccattcctcatggaaaagatggagtagttagagaagcagcttttgcggttgtaactttaaagaaacctgtgaaggattgggaaagtgttgttgaaggtaacaaagtacaatatgtttttttacttgcaattccccaaaatgataagaattcggttcaaatgcaattattagcagaaatgatgacgaagatggctaatcatacatatacagaaaaattatatgcttctaaaacagtaaaagaattttatcaaaatctggataatggggttaatagtgatgaaataaaatcctttgatcgctcaatcgttgcggttactgcgtgtgccgctggtattgcccatacttacatggcagcagaagcattaacaaaagctgggcaagagttgggagtaaatgtatatgtagaaaagcagggggctaatggaattgaagatcgtcatactaatgagatgttaaaaaatgcaagtgcagctatttttgctgtcgatgtagcggttaaagaggaggaacgttttagtcatttaccaacgattaaaacaaaagtatctgcaccattaaaggatgctaaaaagattatcgaaacagcgttagttaaagcagaacaaactgctcgtggtgagtatgtagaacattcacgacatcaagaagccggatttttagaaacagttaaggaagcggttatgacaggaattagtcatgttattccattgatcgtggctggcggaatgattgcagcaatttgtgtaatctttgcaagaacctttggttttacagatttgatgaataccgaaggaagttggctttatttgatcaaatcaatgggaagtggattgttaggaaccttgatggtaccggtattatcagcttatatggcttattcaatcggggataaaccagctttagcttcagggtttgcggctggattttgtgctaataccgttggcggtggattcttactcgggatgcttggtgggatcattgctgggtattcaatacgctatttaaagaaatggattccagctaaaggaacatttgccggttttgtgagttttgtaatttatcctgtattgtcttgtttgattgttggagtcttattgttagtcgtattaggtaaaccagttgcaatgatcaatacagcattagttgactttttaggatcaatggcaggaacaaatgctgctttactaggggctgttttaggaatcatggtttcttttgatttaggtggaccagtaaataaagctgcatatgctttctgtgttgctgcaatggcggaaggagttttaatgccatattgtgcttttgcttcaattaaaatggttagtgcatttggggtgacatttgcgacaaagtttagaaaagatttatttacaccagaagaacgtgaagtaggaaattcaacctggctattaggtttagcaggaatcacagaaggggcaattccgtttatgatggcagatccaattcgtgtaattatatccctatgtactggttctgcagtttgtggagcgattgtagcgatgtttaatattggtcttgatgtacctggggcaggaatattctctattttcgtattaactgctgataatattccattagcgatgatcgtctggtttggagcggcagtaattggagcgattatttcagcggtgctacttgtaattactcgaaaacagaaattagctaaggcaaaataggaggaatagcatggcaaatcaagtacacattgtcccccatatgcattgggatcgtgagtggtatttttcagccgaagaatcaaagttattattactaaacaatatggaagaaatattagaaatgttagaaaataatgaggattatccttattatgttctcgatggacaaacagctgtacttgaggattatctagcattaaaaccaaaaaatttatcacgactagttaatttagtgaaaaaaggtaaattaattattgggccttggtacactcaaactgatgagatggttgtaggtggagagtcgattgttcgtaatttattatacggtcataaagatagtcagacttttggagaacctatgaatattggttatttaccagattcatttggtcagtcaggccaaatgccaatgattttaaacggttttggaattacaagaagcatattctggcggggaacgagtgagcgaatgggttcaaataagacagagttttattggactagtgacgatggttcaaaagtcttaactcaactattaccacttggttatgcaattggaaaatatttacccacagatcttgatgaattaaaaaaacgttgtgataaatatatgccagtgttacaaaaaggagcaactagtgaacatatattaattcctaatggtcacgaccaaatgccattacaaaaaaatatatttgatgtcattgagcagttaaaaagactttatccagataaaaacttctttttaagtaactatgatcagatatttaaagaattagagaaaaaagataactatgatatccttcatggtgaactgctggatggtaaatatatgcgtgtacatcgttcgattttttcatcacgggcagatatcaaaacaatgaataccgtaattgaaaataaaattaccaatctgctagagccattggcttccattgcttttaaattagggtttgagtattttgatgggatgatggaatcgatatggaaagagataatgaaaaatcatgcccatgattcaatcggatgttgttgtagtgataaagtacatcaagaaataagcagccgttttacgattgctaatgagaaagtagagcgaatgattgacttttataaacgaaagattactgatgcaatgcctaaagatattgcgcttgataaactaacggtctttaatttactcccttatccaagaaatcgagtggttcgcagtgaagttatcacgagaatgaaaagttttaaaattgttactagtgagggtcatgaaatagattatcaagttattaataaagaaatcattgatgctgggttaattgatcgtcagattgttcattatgggaattatgatccatttataaaatatacaattgaatttaaagataattttcctgcgatgggatatcaggcttatttaattcaagaagcagtagagccaaaagaaattttattagataaagtggactttctggaaaatgaatactatcagattaaaattaatagtaatggaactttaaaaatatatgatttagttaatgatcatacttatgattccgttttattgattgaagatggtagtgatgagggtgatggttatgattattcaccattattggaagattatatcataacttctaaagatgctaaggcagattatcaaatcaatagatccaggtattctactacagctcatataattgtcgaaatgaaagtaccaaaagatttaacaagtcgtaaacaaaagaaatgtgatacaagtttaaaaattgaatttcaaatagaattaaaacaaggggaacgaaatcttgacattacaactaatattgataatacagctaaagatcatcgacttagagtacttcttccaactgatatttgggctcaggcctcagttagtgataatcagtttgggataattgaacgcccagtaaaagatatggcgatagaatcatggcaagaagataattggagcgagcggccagatagtatttatccaatgcttagttacgttgcaatcaagggttgtccattagctttactcactaattcagttagagaatatgaagtaattggggataattataataccctggcaattacgttatttcgatcagttggctatttaggtaaagaagaattagttcggcgtccgggacgaccatcaggaattaagatgcctacaccagattcacaattattaaaaccattagagtttagatttgcgcttgttattgaaaatgatcacgctaaattatcacgtttagctaaagattatttaacgccattaattagttataataaaatgccgtacaatgcgatgaagttaaatgaggttgattttaacactccatatactttctctctgcttcatgaaaataatgaacttactacactaagtgttttaaaaaaggcagaatcttcaaataaattaatttatcgaacttttaatactaataataaagaggttttaatttctttaaatcatgatcttaaagattttgttgatttaaaagaagagatagttaagactaataataaactaaaaaagaatcaagtaaagtcatttattttagatgattaaataaaaccgtagtccaaatgactacggttttgacagttacctaaaggtgcctactattaaaagactagataatcaatataatgatatataaggaggaataagcaatgttaggtgaagaaaagttaattaattttacgaaaacaaactatcaaaagaaaattactaaagttaatgaacgggtatatcattttttgggctatggacatagtaatgcaattgcgattattggggaaacttcaattatattaattgatactcttgattctgattatcgtgcaaaagtgatgaaagatgaactagcgaaaattagtgataaaccggttaaaacaattatttatactcatggacatcctgatcatttaggaggagcaggtacttttcgggatacagttgtagaagtaatagcatttaaacctcgaaaaccaattttaaaatactacgatagaattagtaaactactaaatcaacgagggatttatcagcatggttatggattaacagatcaggaagcgattagtcaaggaattggaatccgtgaaggaaaagaaattaaagaaggaaaatatgattttataaaaccgacgacatattatgagcaaaaagtggttgaacgagtaattgacggaattaaattaaagatggttagtgctgtaggtgaagcagatgatgaaatctatgtttggttagaagatgatcagataatgtgttgtggagataattattatggatgctggcctaatctttatgcaataagaggaaccatgtatcgcgatgttgcgacatggattgatactttaaatgagattttaaattatccagctgttgcattattaccaggacatacacgagttttatggcaaaatgagattaaagcaatagtgggaacttttagggatgccatcgaggatattttatttaaaacattagattgtatgaatcagggaatgtctttggaagaaactgttaaaaatgttaaattagcaccaatatatcaggataaagaatatttaggtgagtattatggtactgtagaatggtcagtgaaaagtatttataatggttatgtaggatggtttgatggggatcctgtgaagttattgccacatctaactgaggcttataatcaggcggtacttgctttaattggtgataatgataaactaatattagctattaaaaattatatggcacaagaagattatcaaatggcattgcaattaattgagttattgatggtgcaagataattcattacaaattatagaactgaaaaaacgagccttattgatgcgggctaaacaagtgacatctgctaatgctcgtcattatttaattgcatgtgctaaatcattataaagtaaggagagaatatgacaaaaaagattttggtaactggaggaacagtttttgtaagtaaatttgttgcaacttattttaaaaatcatgattatgatgtttatgttttgaatcgtggaaatcgaaaacagattgaaggagtaaaattaattaaaggtgatcgacatcatttaggaaatttgttaaagggatatgattttgatgtggtttttgatgttactgcttatactaaacaagatgtcaaagatttgttagaaggtctaaatggggtcaaagattatattttgattagttccagtgctgtttatccggaaagtttatcacaaccgttcaaagaggagcagaaggttggaagaaattctatctggggagattatggaagtaataaaattgaagctgaaaactatttactaagtcatattcctcaagcatatattttaaggccaccatatttatatggaccaatgcaaaatgtttatcgcgaaccttttgtgtttgaatgtgcattaaagaaacgttctttctatttacctaatgatggtaaaatgttattacagttttttcatgttgaagatctatgcaagttaatggaaaccattattaaaaagcaccctcatgatcatatcatgaatgttggaaatagcgaaattgttgatataaataaatttgttgagttatgttatcaagttgtaggagtaccgctaaataaagtatatgtaactaagcatgataatcaacgtgattattttagttttcataactataattatgttcttgatgtaactaagcaaaatcagctgttgccaagtcaaaaaagtcttttcgaaggattagaggaatcatatcagtggtaccttgatcatccagatgaagttgttaagaaaaattatatagagtttattgaccaagagcttatttaaaataatcttaaattttatatctaggagaataacgtagtatgtggattatctttggaagcttgagtattatctgtactttgatgagctgtctgtctatatttaaaagtcaagagaagctgagggcttattggttttcgattttaggacttgtttttaccgtgcttactcttttagcagggtatcaattagtaagtaattgggtaaagcatgaagattggtcagcattattggatgtagtaccgtcaatgtttacaattcttacaatatatgtaattacgatgttgactgcaaatattattgcacttatattaataagaggtaaatcaaaaaatacaaatgataacttaatgaaaaaaagatagttattaattaaataactatcttttttacgtgattatagtaaaataaagtaaataataactatttatatattgaaagaaataatgataaatcattttaacaaatgttggaattgaaaagattatgaaaaaatatattaaacgtgtagttgctatgggtgtttaaaaaatttataatgcagtatatttatttaaaggatttctttgagtaataaaggaggagctaatggaaataaaaagagtatttgaacgagacgaacagttaattagttcacttgttacggtttgggaaagttcgattagagcaactcatgatttttttagtgaaactaatattcgagaaataaaaaagtatgtttttcaagcaattgaagaaattccaattttagtagttgctgttgataataaagaaacattggcttttatggggattgctgaggataaattagagatgttatttattacagcacaacgtcgaggacaaggtattggtaggaatttattagagataggaataaatgattatgagatcactgaagtctgtgtaaatgagcaaaatcctcaagctctagctttttatgaatatatggggtttactatttatcggcgaagtgaattagatgaacaagggaatccatttccaattttgttcttacatcgtcaataagaattataaatagatatttagaaaggacaaattatgaagttgttgtcattaactgaaaagataaagctaactaaacagcaagaacttgaatttattgatgttctcgaagatgatattaagaagtattttaggatcccgatattttttattatgttatttcaaatctataatatggtctatgtaagtgtatatacggattttacctattataccaagtcaagtaagatttatatgcttttatacacactcatgtttatcatctgtgtcttagggttgattttattgcataaaaagaatgttaaaaagggtttattgttgaaagttcaaaattactatattgtttttttaatcatgtggtcgctagcagtaacgatatatgataatcgtgtttctaataacattagtgtgcatattattacaatgttgagtattgctattcttgtttatttaccgccaaaattatttgttcctctgtatttgttctctgatattattttgattactggaattgaattagtgaaacatggtgaaccattggggagtcattatagtatttatgttaatagtacctggttaacgattatggctctatttgttggatattatcattatcaatcaatgcgacaaacttttttaaatcagagtattattctagaaaaaaataggatgattgaagaaaaaagtgcggaattagattttattgcccatcatgattctttaacggggcttcaaaatcgacgttatttagctaattgtttaaataatatttatttagagagtcgcgatagtcagcttaaaacaggtgtttttataattgatatcgatgattttaaatcttataatgatacttttgggcacattaaaggtgatgaatgtctaaagagagtttctaatgctttaaatttatgtttgagtgaagggtttttgattcgttatggtggagaagaatttgtttatttattaaaaaatacagatttagaagaaatgcaaagaattggtacagaactttgtcatactgttgaacgtctgcatttattaatgccaaatacttcaagtcgtgaatatttaactgtaagtattggtggggcaataggtgttttaaatggagaagaaagttggcaagcagttttagagcaggcggatcaagccttatataaagctaaaaatactaataaaaataaatgtatatgtgcagtcgagtaatatattttatagttgggttatagatttgtttattaaaaatagttttatgattggataggaggtttgaaagagacctctttttttatttagtgatattttaaattaataacattaagtttttattgacttatagttaactctaagatttatactatgtttaaagataaataaggtgagatggaaattttaattatttaaaaaaccatatttaactttttattcttatcgatacaagtgcataatttatagtgcactgttaatcagataaagatttttagtatataaactaaatatatttaaatgtaaaagattatgattgaatcttgaatttaaaaatcaaattattaaaacaagattattgagactaaaaatatatggctagaatagggggaaaaataatggaatatataactttaaataatggtgtaaaaatgcccatggcaggatttggagttttccaaatcaaggataaagaagaatgtgtaagggttgtcctggaggcaattgaaactgggtatcgtttaattgatacagcacagtcttatggtaatgaagaagctgtaggagaagcaatcttaaaaactaatgtacctcgagaagagttgtttgttacaacaaaagtctggattacaaactatggctatgaaaaagctaaggcatcggtggaggaatctttagaaaagatgaaactcgattatattgacctagtattattgcatcagccttttaaagattatcatggtgcttatcgggctttagttgatttatacaaagaaggaaaaattaaagcggttggtgtatctaatttttatccggaccgtttagtagatttatgtttagatacagatgttgttcctgcagtgaatcaggtggaagtaaatctatttcatcaacagaatcaagcattagaatataatcaaaaatatggtgttcaattagaagcatgggcaccgtttgcagagggaaagaagggaatcttcactaatgaaacattaatgggaattggtgaaaaatataacaaatcagtaggtcaagtaattttaagatggttagtccaaagaggaattgtgccattagctaaaacggtgagaaaagaaagaatgttagaaaatattgatatttttgattttcaattaagtgaagaagatatgaaaactattacaaatatgaataaagatacgagttcatttttctctcactatgatccagcaactgttgagatgatctgtggtttaaaaagataaattattaaagcaagatgaaagctagatagctttatagtgaactagtcagaatctacaatatactaggaggtaaaatattaatgagaataattgaattgagtaatggtgtgaagatgccgatcattggttttggaacaattggacagtttggtaaacaagtagaagataatgtttcttttgctttacaaaatgggtatcgtttgatcgatacagctaatcgctatactaatgaaaaaagtgtaggtagaggtattagtaaaagtggattggatagaaaagaaatttttattgagacaaaattagctccgacgttttatgaaaaaagtaatgctgttgagcaaacattagaacggttgggagttgaatatattgatctgatgctgttgcatcaccctttaaataattatattgcgggttatcaaatgatggaaaaagcttataaggaggggaaaatcaaagcactagggttatctaattttaaggttgaacaaattcaagaaattttggatatttgtgaaattaaaccagtagtaatgcaaattgaatgtcatccttattatccggctgaaaaggtaaaagatttttgttttgaaaatgggattattctacaatcatggtatcctttagggcatggtagtaatgaattgttaaatgaaccgttatttaaagcattagcaattaaatatcataagacaacgtctcaaattattttgaaatggcacacgcaaatggggtttagtgcagtaccgggaagtagaagtgctaatcacattttagaaaatatcgagttatttgattttgtactaacaaatgaagaaatgcatgaaatagcaaaactaaataaacattgtccattttatcaaataactgaaaaatcacggcatatactggcaacaacaattccagatgttgacggtgaggaataataagggggataagattatggaatatattattttaaataatcaaatagaaatgccaattttaggtttaggggtatttcaagtaccggataaaaaagaatgtcaagaaactgtatttcaagcaattaaagcggggtatcgattaattgatacagcagcttcttatatgaatgaagatgctgtaggaaatgctgttaagcaagctattgaagcgggaatctgtacgagagaagagctgtttattacatcaaaattatgggtgcaagatatgcgaacatatgaaacagcaaaacagggaattgaaaattcattgaaaaaaagtggattggaatattttgatttatatttacttcatcaagcaatgggagattactttgctgcatggcgggctatggaagatgcatatcataaaggaaagttaagagctataggtgtttctaatttctatccaaatatattaacgaatttttgtgaaattgtagaaattaagccaatggttaaccagatagaactgcatccatattttactcaggagcaagcaatagagacaatgaaatattatgatgttgttcctgaagcatgggcaccattaggaggcggtagatataatccttttgaagatgagatgttaaaaggaattgctgaaaaatatcataagacagtgggtcaagtattacttcggtggaatattcaaagagatgttgttgtaatccctaaatcaactcatatagagagaattattgaaaatattaatgtatttgattttgagttgaataatgatgagatgaaaaaaatttcatccttagatatgggatatagtggttcacgggctaaacactttgaacctgattttgtaaggatggttgttcataggaaaatccatgaataaaaaatagattattaaaggagtgaaaaaaatgagtatattatttattaacggaagtcctaataaaaatggtaatacggttgctttaagtgagcaatttctaaagggtaaaaattatcagacattgcatttagtagattataagatttatagttatggtcagcattttacagatgatcaatttgatgaagttgttttagcgatgagtaaagctgatacaattgtaattggctcaccgctttattggcatagtatgtctggagctgttcgtaatctattagaccggttttatcaacatgttgatgaaagtttattaaagggcaaaaacatgtattttatcttccaaggttatgctccaacgaaacaacaattggaagcaggggaatatacaatgcagcgttttgcaaatttatatggaatgaattatcgtgggatgattactgaataagaaaggataatgctatgatgataaaaagacagttagggaaaacgaatatgtatgtcagtccgataggattaggctgtatgggattttctcatgcttatggcttagctgaagataaagagagagcaattcaaactattaagcaggcttataaaatgggttataatttttttgatacggctgaatgttatactggtgagaatactgatggaactatttcttataatgaagagcttgtaggtgaagcattaaaggaggtaagagaacaggttgttattgcaactaaatttggagttgaacataaaggggatcatttagaattagattcctcaccagaaaaaatatatgcatcgatagaaggatcattaaagaaattacagactgattatattgatttatattatcaacataggatagatcctaaagttgaacctgaagtagtggctggagttatgaaggaattgattgcagcgggtaaaattaaagcatggggaatttcggagacaacagaagaatatttaagaagagcacatgctgtttgcccagttacagctattcaaaatagatattcaatgatggctagatggtatgaagatttattcgttgtttgtaaagagttaggaataacttatgtagctttttctccaatggctaatggattactttcagggaaatttacaccagattctacctttgaaaaagggaattttagaaataatatgcctcaatatcaaaaagaagggtatgaaaaagcaaaaaaattattgaatttgttaaaagtattatcagaaaagaaaaattgtactatggctcaactttcaatagcatggatgctaagaaaaaaggattttattgtgcctatcccgggaagcagaaaattagaacgtttagaagaaaattttagagcaggggaaattgaagttacaattgatgaaatcaaagaaattgatgctttattagatacaattgactttgatgtcttcggcggacattaaaaatgaatataagtgaaaatactactattcaagaagtattagaacttccagcctttaaaacatggggaaggttactatttccaatcaatagaccgatagctctaaatatgacgattaaagaattaagttcgtctaaaatttatttatggtataattatatagatgtgaataagacaattgagattataaatacactcaatcacgatgctcaaaatcattcaatattttataacatttattctaaagaagaattattaaatgatgcttcaaaaagagatgtaggattgttcttttttaaaggaagtaaagatgcgccttttgcaatatgcaatgctggtggtggttttgtatatgtaggagcaatgcatgatagttttccacatgctttagagttaagtaagcgtgggtacaatgcttttgctttgatttatcgtgttgagcatccgtatgaagatttagctaaggctatttcgtttatatataataatgcgaatatgctgaaaatagataaaagacactattcactttggggtgggtcagctggtgctagaatggcagcagtattgggaaataaaaagtttttatcttcatatagtgaaattgctgtcccttcagccgaagctgtcattatgcagtatacagggtatgattatgtttcaaatgaagatgctccaacttatgcatgtattggaacaaacgattatattgcagatcatattcttatgaaaaaacggttagagcacctaaataaattaaatattccaactgagtttcattgttataagggtctatcacatggatttggcttaggcacaggaacaatagctgaaggttggatagatgatgccatttacttttggcaaagacaatcgtaaatatgttgaataaaaaagactttacaattaagttaattaatattgtatcgtctttttatttggtcataaagataatgttatttgatgttcattattatggatgttaaaataaaattataaagagaaaagagggataaaatgactgaaaaaaaggcagtttttgattttaaaggttggattcgagagcatcataatactccatatgagattcgtttagaaaacgatgatcttattaaattagtaactgaatacggtggggcatcgattcaatttacagtaattgaggaatatacaatcgttgaatttagtattgtttcaaataaggatcattctgttaaattctatcttcattttgaactcaatgatgaaaatcatgcaaagcaattatatgatgagatggttgaaacattgattgggttaaaagaagaaaaaactttgcgtgttttattatcatgttcggcaggacttacaacttctatgtttgctgataatttaaattctgtagcaggaatgttagggttagattaccattttgatgcagtatcttatatgagtatttatgaagaagcagaaaagtatgatgtaattttaattgcaccacaaattgggtatatgctcaaacgtttaaaagagagtatcacagaaaagccggtattacaaataccaacatcggtatttgcttcgtatgatgctttagctgctttaaagtttattcaaagtgagcttgagattttccgccaagaaaaaagtaatgagcaagcgcatgaatgtacccattgtgcagaatatgaaaatcgtatcttatcaattgttattttgattagtagagagcagacacgtatttattatcggttaaatgataaatgtgaaataattgatagtaaccttgtcattaaacctacaatgaatatatacgatctctacgatattattgataccattttattaaaacattcttacattgatatgattggaattgcgacaccgggtattgttaaagatgaaaagcagttgaaagaaccaacagatggaagaactattgatataaaagctgattttgaagataaatatggaattgatgttttcgtttataataatgcaaatgcagcagttgtaggtttttctttagaacatccagagtatgataatattattttccattcacagccatttggatttggggtagggggacaaggaataatttctaatggtaaagtaattagagggaaaaatggtatagcaggtgagataagatattttatccgacggatgcaattatctgatgatgttcataaactggcttggacacagcatggagccgtagagctcgtaacaaaatcgttacttccaactatttcgctcattggaccagaagctgtagtgataagttcaccaatgacaccggatatggatgaagtaaaaaatgtgctatcctcttttattgataaagaatttttacctgaattttattatattaaagaagccagctcttatatgttaagcggaattacaaaattatgtgttgattttattgaagaagagtaggatatttctaatatagaaataagtctttatcttttagtgacaaaagataaagacttattttcttaaagtggtaattatcaaagctatttactcatttatttcaataagattacttgtgtacctgcattttccttcaagtacgtcatcgtaaaagcgttgtttattatcgatatattcaatacactcatttatttctgcaattctttttaacaaatgtttttttgtttggctaagcatatctttacgttggggaattgaagttggcccttgtaaacaataattcatatatatttttatttcacttacgcctaatccacattttcttaaacattgaattccttttaaccaggcaatatttttctcatcaaaattacgataattatttttatctcgttttacattaggaacaagaccttctttacaataaaactttaatgtttcataattcataccaatttctttacatacttctttcatcgtacacataataaatacccctatttttgatttattttaaaaaattattgaccggtagtaactaccgagtattacaatataattgtaagataaataaaaagagaaatcaaggaggatagaaaaatgaaagttattttaattaatggaagtccaaatgctaaaggatgtacgtatacagccttagaggaagtatcaaaaaccttaaagagtgaagggattgaaactgagattattcatgttggtcataaagatattcgtggatgtatcggttgtcgtcaatgtaagacgaaagggaaatgtgtatttaatgatattgttaatgatattgcaccaaaatttaaagaatgtgatggtattgttattggttcaccagtttattttgcgtcggcaaatggaaccttagtatcatttattgatcggttattttatagtatgactgctgataaaacaatgaaagttggggcggctgtagttagttgtcgtcgagggggtaatagtgctacatttgatgaattaaataaatattttactatttctcaaatgccgatagcctctagccaatattggaatatggtacatggtaattcaccagaagaagtacagcaggaccttgaaggactacaaacgatgagaactcttggtaagaatatggcttttttaattaaaagtattcaattaggtaaaaaggaatttggattaccggaaaaagaggagcataaattcactaattttattcgataaaaagtaagacgacagtatggtaatggatttgttcccatattgttgtttttattgtagattgtgaagttctttagtaagcaaggctaaattatcaattgtttttttattaagaaagtgttcaattttctcaacttgttctagttcgttatgactgttattgagtagacagagaaagttatttaatacctgatgacgatatataaaatattcaccccattgtttacctaattcagttaacgtgataattccatatttttgatattctaaaaagccttcttgacttaatttagttaccattttagaggcggatgagggtctaacattaagattattggccaattcgttgattctaacgaagggttgtttttcttttaagcgaatgatcatttctaaataatcttccattgaagaagttaagttactgtcattattcaattgatagcccttgaaagtaaaataggcattttcatcgttattcatttttttctcctttttagtaacgctttactagtaatttaatattatagtattaggaaacaaagtttccttaatctaatatacgatgaggagaaatttattatgatagaaaatagatgtttaaatgatttacaaatgggtgaagtaggagtgattacttcattaatggcacaagggagtattaaaagaagacttttagatattggcttagttgatgatacggaagtacaatgtattttgaatagtccaagtcaagatcctaaagcttttttgatcaggggtgcagtaattgctttacggaatgaagattgtcaaaatgttttaattagaaaagatgatgtgaattatgggcttaactaacaaatctacaggaattaatgcaagtgagacaaagttagtaataaaaaaacaaagtagaaatgataaagttgttgccattgcaggtaatcctaatgttggaaaaagcactgttttcaatgggctaacaggccttcatcaacatactggtaactggcctggtaaaacagttactaatactcaaggctattgtcgaggaaaagaaaattcatatgttttagtagatattcctgggacatattcattattagcacattcagcggaagaagaagtagcacgtaattttatttgctttgagcatccagatataattgttgttgtatgtgatgcaacttgtttagaacgtaacttaaatttagtaattcagacaattgaaattcatacaaatgtaatagtttgtgttaatttgttagatgaagctaagaaaaaaggaattgatattgatcttgagcaattatcatcttgcttgggagttcctgtaattgggattactgccagaaaaaagacagatttgcataaagttattgattctttagatcaagcaatcgatagaccagttaattacaaatccttaaaaatagcttatagtgatattttattacaagcaataagaattgttgaggaagtattgcaaaagaaagtaactacttctttaagttatcagtggcttagcttaagattgattgaaaacgatccttccttaatgattgaaatgtcaaatcaattaggactggactacgatgatcaagagcttaaagaagctatcgaccaagcaaatgaattattagcacaacatgatataaataaggataatttacaagacaagattgttgtttcatttattcacagtgctcatttgatttgtcaaaaagtggttcactatcaaaagcaagattataatcaaagggatcgtcagatagacaagattttaacaaatcgctggacggggtatccaatcatgattttattacttgctttaatattttggataactataacaggggcaaactatccatcgcagtggttatcggatttcttatttggattagaagtaccttttaatcagttctttcattttattgggacgccgctatggcttagtgatatgcttgtatctggggtatatagggtgttagcttgggttgtaagtgttatgctgccaccaatggcaatcttttttccattgtttactttgatggaagatttaggctatttaccaagaattgcttttaatcttgatcatgcatttaaaaaatgcagcgcttgtggtaaacaagctttaacgatgtgtatgggatttggatgtaatgctgctggaatagtaggatgtcggattattgattcaccacgagagagattaattgcaatgattactaataattttgtgccatgtaatggtcgttttccaaccttgatagcaatcttaacaatgttctttattggaaccgaagcaactatgcaaaattctctattatcagcaatatttttaacaatgttaattgttttaggaataactatgactttgattatttcaaagttattatctaaaactatattaaagggagtcccatcttcatttactttagaattaccaccatatcgtaaacctcaagttggcaaagtgattgttagatcaatttttgaccgaacattatttgttttatctcgagctgtggcagtagctgctcctgctggtcttattatttggttaatggcaaacattagtgttgatggtatgacaattttaaatattacttctaattttctggatccctttgctaaatgcattggtctagatggcgttattttgttagcatttattttagggtttcccgctaacgaaatagtaattcctatcatgattatggcatacctcgctagtggtagtttgattgaaatggataatttagtaatgttaaaaagtttattagtagaaaatggctggacgtggatcactgcaattaatgtaatgttattttcattaatgcactggccttgttcgacaacacttttaacaataaaaaaagaagctaatagttggaaatgggcgattgtatctttcttagttccagctgtaaccggaatcataatctgttctatcttcactatgtgtgctaatctgtttatctaaatgatttttaataataatgaaattgaacctcttagttggatttccaactaaggggtgaactatataaagatgatatatggttttattgagataagtagctatagatgatatgatattaaaagacaggggtggagaatataaatgacacgtccaaattttaatgatattcaaagttttgatgaatttaaacagtattattggtatcgtgatgaactaaaacaaatttgtaaagaacacggaattactcatacaggtactaaaacggaactgaatgataatattaaagcctattttaatggtgaaataattaaaccagtaaaacgaatgaaaataaggaagcaagatgtgcctttaaccttagaaacaaaattattagaatgtggctttgttcttaatggacgttttcgtgaattctttggcgaaattacaaaaacacctaattttaagttcaccgcagatatggcaactgcattgagaagggttcgaagtgaggggaatgttcatttcacgctcaaggatcttttagatgtgtattatggaaaaagtgattatgctaaatatgataattcagcttgtcagtggaatcagtttttaaaagatttttgtcgtgatgaaaataataaaatttattataataaattgaaagctgcttcgatattgtggaaggttattagagatcagccaggaaagaaagtatattcagcttcattattaaagaaacatcaagctttgctaagacaatataaaggggaaaataaatgaaaagagaaatagttagtgatcaatttagactaagtcaaaaatcacttccagctactaaagaggatttaccggttgttcaagatttattagatacgattatagctcatgctacaggttgtgtaggaatggcagctaatatgattggtatcaataaaaatattatcattgtaaacgatgatggtaattatttagtaatgttaaatccagaaattataaaaactatgggacgtttatatgaaacagaagaaggatgtctatcacatattggagtgaaaaagacaaagcgatacgaaaagataaaagtagcatattatgatgttgatttcaaaaagaaaataaaaacttttagtaattatacagctcagatcattcaacatgaaatagatcattgtaatggaattttaatttaattaaagaagtaaaaggaatgatataattgcagtttactatataaatatttaatggtaattttaaatatgattatgcgccaaaatgatgatggaaggattattgtaattcattcagttgtaatgaaagatatttcagcatattctgttattggagagaattcggctcattttagacaagaatgttttggtaatgaaatgatcgaattgttgggatggttaaaatgataagattatgaataagaaaaactatgtgatctctccctttattacgtaaggaagatttaggtgaagtaaaaaagagagtttataaaattattaatggtgaaatcgatggaaattagaaaatatcagtcttcggatttaaaagtaatttgtgaattgttttatgaaacgattaatacaataaatagatatgattacaataatgatcaaatcaaagtatggtcaaatcggagtaattttctgctgactcaagatgacttttttaactctatgtatactcttgtagctgttgaaaatgaaaaggttttgggttatggtaatattgataagagaggttatttagatcatttatacgtacataaagattatcaaggaaaacagattgcaacaaagctatgtgataagttagaacagtattgtaaagatgtaaaaagtttaacagttcatgcttccataagtgctaagcctttttttgaaaaaagaggatataaagttattaaagaacagtcagtcaaagtggataatgtttatttaactaattatttgatggaaaagactagataatttgatttagcagtttaagatgccgttaggcatcttttaattcgtgatagattattgattatgagataatataattagattgaggatatggatagtgattgtctttgttttagaattaactaaggatggtaaagtaatcaagcaaggtaattttacttacaaaattagaatatctttgttttgttatgattagcaatatatacttatatcgataaaggagtaatttgaaaaatgagaatttgagtcaaatggtctttttaagatatatttttatgatgaagaatcgttaagtgatagaaatgatgaatcagctaattagggtgttataataaattaaattgtttaaagactattttaatcaggattaaaaggaaagggggattactgaagattttggaatttattatcaacaaattataagaatagagaaaagtcgtgatgcaattgcatcatcagctaattctttggatcggctcaatattgttacagagcaaaaagatttttatatttctttacaaaataatgatttatttattagtcaaattagaaaatttaaaagagagttacagtataaataattttaataaagaaattaaaatagtagaaaatcttcaaaacagttatatatttgaggacaagactgggatatggaataaaaataggggaacttttatattagtgcttatcatagaaatttaaatgattttattgaaaactatttgttgaaggatgaaaataaatcaaactgtttaaacaaatacaaaaagctggttatcgctattgtggaatccagcatggtaattttaattattatttattttgcggggacggaacacatatcttttagctgtatacattgtcataataaagttagaaaatatgattatttagtgtaatttgttaaatatctaaatattttatagcagtaagctaaaaatggataattaaagatttttagcaaaacaatatttttgcaatcgacaggcaaatactgtgactaagtttggttttatcaaagaaatttataagaagttattatatgatgttcttgaaattaacatgaaatagggctatattcatacatatagattgggggtattcaatgaaacgaacaaaattagatgatcgagtattacccgaatatactcgaggtgaagaaatttttaatatggttactcatattgtaggtggagtttttggaattgccgtattagtactttgtattgtttttggagtattgcgccataacaattatggtatagcttcaggaattatttatggaatatcaatgatcttgctatatacaatgagtagtatttatcatgggctttccccaaatactaagagtaaaaaagtgtttcaaattatggatcactgttcaatttttgtattgattgctggtacttatacacctattgtgttgtgttcgataagaccagtagattcattttgggcttggatgatctttgctgttgtttggggctgtacggttctaggaatcattttaaatgcaattgatattgaaagtaatgaaaagttttcaatgatttgttatttagcgatgggctggtgtattatctttaaattcaatctattgccggaagctattggatataatggaatttggttacttgtggctggtggtgtagcttatacgattggtaccgttttttatggtttgcaaaataagtatcgctatatgcatagtatttggcatttatggatcttattaggaagtgtgttacatttcttatgtataattttatatgttatttaaaaggtatcattttaaaaatgatgctttttttacgataatatagagaaaatggggctaaagagtatcataatagtgtggtattaataattcaatgaggagatgataggtataaatctattttatccatcaattattaagtttgctcgttttaaaatgcaaccaaaaagtaatgatatttttactattctcgaaaatgtccactaagtagttgatattccttatcaagatgacaggaatcataatcatttactagatatttattatccttaatccacgactaagccattgtctatgatcattgatgttcacggtgatgcctggatttatggtgataaaggagtaaataaaaatttgcagttatgctagctgctaaaaattttactgttgtgaatataaattatactctaataccacaagcctcgttgaagcagtaagttcaggaaattattatgactttaaagtttgttgctaaaacaaagaataaatatttttggaatattgatcaaattatttttactgagtgattcagctggtgggcatttagcaggattggtttatgtaatcataaaacagcctgagctctgtaaagtatataatgttcagccaccagaaattatgattagagagttttgttacatggtggagatgatttaataagttttgactaacagtaaaaattttgtttatcagtaggttagtgttatggttcagggagttaacaatgaagattcagacatatatcgaaaagcttgccttattgatgtaattgatagttaccgccactttcaacacgtattattagtagtgagataacttacatttttagtcaataaaggctaaaaatgtattgaaggcttataactggtatgtttgaaccgtgtgttgctctaaggaaaacatttaggacatgtttttgaagttctgtatcctgaatatcttgaaactcagtcaacgattgaacgaattaaatattttattaataactaattataatgaaggtttttaagtagttattggccttgcattttagtttagaaaatggacagcgatgatataggtggtttatctttttttcatagaaaaatgagctaaactattattaactataaataggaggggaaagtgatgaaaaaagaagttggattattacatttggctgttatgttatttggcttagccggagtaattggaaaatttgtcacactaccagctattttgattacctttggacgagtatctttttcttcaatttttctattaataataattttaataaaaaaagagaaagttagattgagtaataaaaaagattatattctaatcatcgctgctggtattgttatggcacttcactggttcacttttttacaagcaattcaattatcaactgttgcaattggaacaattactttttcaacttttccactttttgtgacttttttagaaccgctagtatatcatgaagagcttagaataaaaaatataatgattgcgctaacaatgtttgctggggtaataattacaattccagagttctcacttaacaatcaaataacactgggaatctttattggattaatcggatctttaagttatgcggtgttatgcttgatgaatcgctattttgcaggtaaatatacagggagaacgatttgcttatatgaacaaggaattgctgcgattatattattaccgtcattgctgatagttaaagcttcaataacaaaacttgatttatttgcgcttatttttctaggagttatatgtacggctgttgctcatagtatttatgtcagtagtttaaagaaagtaaaggtgcaaactgcagggataatatcgggaatggagagtgtgtatagcattatttttgcgatatttttgttacatgagattcctggagtaaaggaactgcttggaggagtgattattttgggggtggctttttatgccactgttactaataataaaaagttttagttctaatttgaaatgaacttccattatttggacacccaatgatgtgtaccctctttactggacaaatcagtaaggagggtacacattacaagtaatggaggttcattttattatggcaaagattcttttatttccatttttgatataactgttcaacaagtttaattgtttcaatagttttttctttattcatgataggactttctaatcgaccattattaatacattgatgaatatgttcaatttcataaacaaattcactttgataaggaaaatcataatgactatgactgccatcatcgagataaagatctaactgattagatttccaataattaggaacaacgatataacctagttctccataaaaaacagcttcattttttaatgccacattcatagcgattgttgaagaagcaagaatactattatttatcttcaattggaaattacatatttcatctgctccagtagagcacttgatacatgtaccatcaattgttaaatttggatgatcaaaaagatattggagatattcaattgtataagtagcacttccataaagagcaccaccacctaatgatagatcatacatccagtgatcgtaagtaaagcgacctggaaacccagccttaaattctaagtatttaatttttccgattatctcactattgattaattctttaactttacttgttgtgggaagatagagagccttttgtgcttccattaaaaaacaattatttttttagctaatgtgaataattctttagcttctaagacagttaaagcaaaagttttttctacaataacatgtttatggtgttttagagcttttttgcagttttcatagtgttgactgttaactgtaggaatataaacaatatcaatattatttgcacaaagcaattcaccataactgccataataattttcaatgtttaatcgttttgctgcttttttggcagtttctaaatttcttgatgcaattgcttgaacatagctatcttggctttctctaatccctgcaataaaacgatcaatgattgaagcagtgcttaatataccgtatctgaacataataaaccaattatagtataggattttttagacaaaaggacaaatttgtttatattattttattttttgaagactataatataagtatagaaggtgatagagatgttaagatttaatgatgattttgattttcgaagtgaatttgttggaaagtggaataaaaagattcactcattaagagtagcaggaattattgttgctattttaatgattatttgtgctattctatgcatgatttatccagtaaaatcagttactataattggtacgattgcaaccgggttaattcttattttaggaatttatcagatcattgattatatagcggcaccaccattatttcgtggtccaggtggccttgtaagcgctatttgtaatttattaattggtcttttgttgatatgttcaccaattgaaatgacaattaatacatttgcttttatttttggatttattttaatggtttatgggcttaataagttgagttttgctcatcaattaagcttttttggaattgaaagttatggttgggttatatttacgggtataatcaatgttttagcagctttagcatttattattgcgccattgatgtcaaccgtcgtattaaattatattgtagctgcttatttacttgttggtggtattgctttattggtcgaagtaattgccatgcatgatttaaaattataatttttagatatttaaaaagcatttcggtaatcggattataaattatcgagatgttttttgtttgcttgtttttaagaaggtgctaaaattaaataaagaaatgataatggaagctgctgttttatgttttagtgaaaggagtgatgatgagtgtttgatttttttaaaaagaaaaaagatccagtcgaagagtcaggaaaactagaaatgaataaagaaatgtttttaagtacgatgaaggtgattacagactatactcaaagagatgttattaaaattgaattaagtaatgatgagtgtagtatttttgatagtaaatttgggggattaccatacttaggagtagatgacgaagtaccattaagtacagataataaacaattgcgattgctggggcaaattaattttgctgatttaccgatgaatagttatcaattagaagcagggttattgcaattttgggctatggataatgatctttatggtttagattttgagaatatgatatcgcaagcagaaagtcgggttatttattattcaagtattgataaaactgtatctgaaagtcagatacttaataaatatcatcctgaaggtgagggttattttccaatagttgataactttaagctgcattttattggtggcgaagaaggaataagtattggtgattatcattttgatggtttatttacacaagaatggaataacttatacccaaataatttaatttcatcatattatgatttaccagatgaaattttgtatgaggatgaatttaatgaatttagcggttttgggcataaaatgtttggatatcctgcatttactcaagaagacccccgcagtagtgaaaagtacgatgattatattttattactacaaattgatagtgtaggtattggtgataaagagattatgtggggggatagtggtatttgtaatttctttataacaaaaaaagacttagagaataagaatttctcaaaagtcttgtataattgggattgttattaaaatcgatgttctattgcttctaagacagctgttaaatcacgaatataagcagcttgctgtttttttaaatatcttttgacaaagggtttcatgaagaattttttaggtgtgatattttctgtaaaatcaattgaagtaataccattgtgagatgaaaataatcctatccagtgacctttcatattactgttttccatactgaattcataacgctggtagggtctaaaacaggtaatcgtaaaagttgttggataaccatttttagtgtattcgataaattgctcttgtgatttgataatttccagttttgaaagatcactgcgccaagtataattatctagggaagtaacaatattccaaatagtttttatatcgttaggaaaagaggccttaatatttgtaattaccataacataactccttatttttttataattggtaaccagtattcgtaaatggcatcatttggatcggcttttagataaacttctatatctgggatattagcatattcatatccggaagtaggcaaccactctgtaacaacacgacgctgaagctcttgaagagttctatttgttccgtgaccagaaaagatggcccaggtagcgctgccgatatgatattcttcaaaattttgattatgattagttgaactaacagcaatgaaataacgccagtcttcgtgttgatgaatattgactcctaataatcctagcggagtctgattattaagtcgataaagttggttaagggttccatcatttaatgctttgtcccattgcttagggatttggacaaagttttctagtaattctttacttaaaagagagctgattcctaggattttaaagctatcctttttttcaattctaaaacttaattcatcaagaccttgaattgaaaaggtgaattttagagctgggaatgacttgatttgaacatttttctttctaacaagtgagggtgcaattccatgaactgcttggaaagcacggttgaatgcggttggtgattcatatccatattttaaagctatatcaatgattttgtcttctcctgtttgtaaatcaactgcagctaaagaaatacgtcgtttgcgaatatattctgataatgagatattagtcatgtaaaggaaagttttttgaaagtgataactagggcagccagctattttagcgagctgctcataatcaattttttctgttaaatgattttcgatatattcaattgttgtatttagccgttcaatccattccatttatgttaccctctttattataacttcttattaatgatcaatcctcgctttttatataaataaaaagcgagattacactttttattttatcttgacttagagctaaccacaagatttattcaggatttaaatgatttagattatcttaataagatagtaaactatcattttaaagtgaagcagtatcgttaatcgctttatttaacttttatgctataatataaacatatcttgggaataaatattgataggaggtaagatatgagcgatatatttattaaaaatattccccatgaacaaataactacattagcatcgcaagtggaagttcaagcgggacaagtagttagtaagacactagcacaaaatgatgctttaagtattactattttttcttttgataaaggtgaagaaattggaacgcatggctctagcggagatgcgatggtaaccgtgctagagggtgttggaaagtttacagttgatggtcaagaatatgtcttaaagcgtggtgaaacattagttatgccggctaataaaccgcattctgtatatggtcaagaagcatttaaaatgttattggttgtggtttttccacaaataaaatagtaaaaataggagactgatcgggtgaagaagactctatatttaatgcgtcacgggcaaacgctatttaatgctcgtaaaaaaattcaagggtggtgtgatgcccctttgacagagttaggaattaaacaagctaagatagcaggaaaatattttaaagacaataacatcgtttttgatcatgcttatagttcaacttctgagcgggcgtgtgatactttagagttagtctgtgatttaccttatcaccgagtcaaaggactaaaggaatggaattttggaatatatgaaggtgaaagtgaagatttaaatccgccgctgccatatggtgatttttttgtcaattatggcggtgaaggagaattacagatgcgccaaagaattgctgatacattattagaaattatgcagaaggaagatcataaagttgtgcttgcagtttctcatggtggggcatgtcgtggttttatgagatattggcaggaaactagtcaagttgaccaaaaaggcggcttgaagaattgttgtattttaaaatttgagtttgaagataatgagttcagattattagaaattattaatcataattttgatgaaacgaaaggttaaaacctttcgttttttacttgacttaaagtttactcaagggagtataataaaaataggaaatgtcgaattgtaggaggatgaaaatggaaacagtaagattggggagaacaaatattgttgttaatcgaaatggttttggggctttacctgttcaacgagtgaatatggaagaagcaaaagttattttaaagaaagcatatgataatggaattactttttttgactctgctcgggcttatagtgatagtgaagaaaagattggtagggctcttagtgaggtacgccaaaaaatttatatttcaacaaaaacgatggcaacgacagtaacggatttttggaaggatttagaaacaagtttatcgttattaaagacagattacattgatatttatcaatttcataatccgtcgttttgtcctaagccaggggatggatcaggtttatatgaagctatgctagaggctaagaaacaaggaaaaattagatatattggtttaaccaatcatcgtttacatgtagcaagagaagctgttgagtgtggtttatatgatactttacaatttccttttagttatttggcttcaaaaaaggaagaggaactagttgatttatgtaaagaaaaagatgttggttttatttgtatgaaggctttgtcaggtggtttaatagaccgttctgatgcggcatatgcgtatttagcgcagtttgataatacattgccgatttggggaattcaaaaagaatcagagttagatgaatttattgagtataatgataatccaccaattatgagtgaagaaatcaaagcgataattgctcatgatcaaaaagagttatctggtgaattttgtcggggttgcggatattgtatgccatgtccaatgggaatagaaattaatcagtgtgctcgaatgtctttgatgttacgacgagctcctagtgcaggctggttgtcagaacattggcaagaagaaatgaaaaaaatagaaaattgtattaattgtggcaaatgtatgtcgcattgtccgtatggattaaatacacctgaattgttgaaaaaaaattatgaagattataaaacattttttaaataattagatatacgattcctagttaaaactaggaattttttaaccaatattagaactatcttatgttataatgaaatcaaagtgcttaaagaaaggagaaattaatgcgtgagatagatcgtttagtcgaagaaatccgtcatttacagtttgatgatatcgagaaaatgtatcaaaaatgtttgcagttaaaagaaatagcactagaacaaaaagatgattacatattatgtttagctagtaattacataatcgattactattattcttgtaaatcgcaacaagaaacagttaaattagcgaatgagatgttggctctaaatgaagaaaaagggtatccagatttattgatgcaggcttacaacctatatgctattgcagtatgtaataatgattattctcttgctactggtttttatctcaaaggattgaagttagctgagcagttaaatgactatataatgaaagcaaaatttaactgtaatttaggagatgtttttgttaatttaggtcaatttgatttagcgttaccttattttttagaatcgcttgaacagatcaaaaagatttctcctaaactgccggaatataaaataaaacgttttgtgttatgttatcttattataatttattgtgaaaaaagaagattggatcaagcgattgctctaatggaagaaaataaggatttatttaatgatacttcatttgatccgattgatcggttatggcaagcattaaaagcattaatttgctatgggcatggtgatgtagcaaaagctttagagtttattgataatatattagggaatgagattcatggttttcgtgcaaatgaagcaatttattttattcatcatattttattgtatattacttttgcaatcaaggataaggagcggacaaaatgtctttatcttttattaaaggagaatgattttggtaaaactggaatgcgttatcaaattgaaatgttagaaatgaagataaagtattgtattgtttttgaagaaaaagaacagttgcctaaattatatgaacaatattattatttgatgcatgaaaatcaaaaagaaagtattgatttttgtttaaatagtgttttatataaaattgaactatttaaagcaatggaagaaaaaaaagatatcgttaaggagtctagactagatgatttaactaagatttataaccgacgatattttcattataaatatagtgagtttaaaaataaaagtcgactattaggaattattatttttgatttggatcattttaaagaatacaatgatagtttaggtcatttaactggtgatcaaatattaaaggattttgctgatagtttacaacaagatgatgatagaataatttcttgtcgttttggcggtgatgaatttatttgtatttgtgtagattgtaatgagcaaatgataattagttttattgaacaagtttatagtaaatttgagttatatgggtatgataaaatcactatttcatctggatattataattcttttagtaattgtttatctaaagaggaattaattaataatgcagattattatttatattatgttaaagagaatggaaagaatggatactatggcttttcaattgagtgattgtttagactcgacagttagtaattttaatgtataatatagttgaattaggaagatgataatcttcctttaatattgcaagttgaggtagaaaatgagtatattaagtgtggaaaatgtcagtcatgattttggtggaagaactattttagaaaatgcaagttttagattattaaatggcgaacatattggtttagtaggtgctaatggtgaggggaaatctacttttttaaatattattactggtaagattgctccggattcaggaaagattgaatggtgtaaaagaatttcaacaggttatttagaccaacacacagctttacacccaggaaaaactatatatgaaacattacaagatgcttttaaatattattatgatctagaagcggagatgttatcgatgtatgaacaaatggctgattgtgatgatgaaacgatgaatcagttgatggaagaagttggtgaaattcaagaaattttagatcatggcgggttttatacaattgatgttaaaatcaaagaagttgcaggtggtctagggttgaatgatattggtttagataaaccggttgatgcgctatctggtgggcaacgttcaaaagttttactaactaaattattattagagaatccaatgattttaattcttgatgaaccaactaactatttagatgagcagcatatcaattggttaatcaattttttaaagaattatgataatgcttttattttagtcagtcatgatgttagttttttaaatcaagttattaatattatttatcatttagaagatggtgtattgactcgttataaaggtgattatgactactatttacaacaagttgaattgaaaaaacgtcagttagctgctgattatcaaaagcagcaaaaagaaattgctgatcttgaagattttatcgcacgtaataaagcacgggtagctactcgtaatatggctagttcacgacaaaagaaattagataagatgaatcttatttctaaaccaaaggaaaaaataaaaccgactttttcttttatagaagctagaacaccaggtaaagtattatttgattgtaaggatttagtgattggatatgatagtcctttaacgaaagaaatgaatcttgtttttgaaagaaataagaaagttgctattaaaggtgtcaatggtttgggaaagacaactctactaaagacgctgattgggatgcaaaaaccttatagtggaacagtagaaaaagatccatttgttgaaattggtttttttaaacaagaagaatctgcagtttcccaaactgcattagactatttgtgggaggaatttccagatcgaaacaatggtgagattagagctatgttagctaagtgtggtttaacaactgatcatattgaatctttaatgaaagttttatcgggtggagaaaatgccaaagttagattatgtaagattatgaatcgtgaggctaatgttttggtgttagatgaaccgacaaatcatttggacgttgatgctaaagattctttacaaagcgcaatcaaggcttttaaaggagctgttattttagttagtcatgaaccggaattttatttaccaattgttgatgaagtaattaatttagaagaatgctcaactaagattatttagaaatgttctttatttagaacattttttgttttaaatattttcacattttaagggttgttgacatatattatagtggtgaaatatatgataactattagtgtgtgtatgatcgtaaaagatgaggaaatggtattagagagagctttaaaatcggttgaaaggattgcagatgaaataatcattgtggataccggatcgactgatcgaactaaaaagatagcattgaaatatactgataaagtatatgattttgtatggtgtgatgattttgctaaagcaaggaattattcattttcaaaggcaactatggattactgcatgtggttagacgcggatgatattatttcagatagcgatcaagaaggtttgattaatcttaaaaaaactttatcaaaagatacttctgtagttatgatgaaatataatgcagaatttgatcagaataataagccgacatttacgtattatcgtgaaagattattaagaagaaaggataatttttattgggaaggatttatacatgaagtaataagtcctagaggtaaggtgctttatagtgatcttgcaattacacatagtaaggtgaaaaatagtgatgttaatcgtaatttaagaatatttagagaaaaattgaatgaaggggtaatgtttagtccacgagaaattttctattatgctcgggagctgttttatcatcaattgtatcaagaagcagtagctgaatttaaaagatttttaaataccaagaagggatggaaagaaaataacatttctgcctgtcaatttttaggctattgtttttacaatcttggtgatatgcaagaagcaataacctggcttttaaatagtctttgctatgatttgccaagagcagagatatgctgtgatttaggtaagtatttctttgaattgaagcagtatgagcaatctatctattggagtgcagtagcattatcgtgtgagcgtgatgatacatctggagcatttatatctccagattgttatgattatattccctatatgcaattatgtttatgttatgataagctaagtaattataaaacagcaaaatattacaatgaattggcaggaaaatgtaaaccaaatgatccatcatatttgcataataaattgtattttaatcgtattgaaaatgatgaatagaagtaaaaaaagatttaaaagggactaatccttaataaaggagtaagtccttttattataatatgataaactattattttttataaggcgttaagggtatacgatttacatatgtatctagtaacttttttatttagataattactttagaagtttaatgaaaaaattagtcttttattttttatgagattattgacacagtagttattaaaatatttgcgtatattatattagatcacataaaggaggtgataagatgaaagactgtaattataatggttgtatatggtgtccatgttgccgatgcaggccaccaattattattagatgtccaaccggaccgaccggagcaacaggagcgacagagccaaccggagtaacaggagcgacaggaccaaccggagcaacgggagaagacggagcaacaggaccaaccggagtaacaggagcgacagggccaaccggactgactggagcaacgggagaagacggagcaacaggagcgacaggaccaaccggagtaacaggcgtgataggaccgaccggagcaacaggagcgacaggaccaaccggaccgaccggagcaacgggagaagacggagcaacgggagaagacggagcaacaggaccaacaggaccaacaggaccaaccggagtaacaggagcgacagggccaaccggactgactggagcaacaggaccaaccggaccaaccggagtaacaggagcgacagggccaaccggactgactggagcaacgggagaagacggagcaacaggaccaaccggaccgactggatcaacaggaccaaccggaccaaccggagcaacgggagaagacggagcgacaggagcaacgggagaagacggagcaacaggagcgacaggaccaactggaccgaccggagcaacgggagaagacggagcaacgggagcgacaggaccaaccggaccaaccggagcaacgggagaagatggagcaacagggccaaccggaccgactggatcaacaggagcgacagggtcaaccggaccgactggtacaaatggtgcaaacggagatagaggaccgacaggaccaactgggataacaggagcaaccggagcaaccggagcaacagggtcaaccggaccgactggatcaacaggagcagctggagcttcagcaataataccatttgcatctggtttacctgtatctttaacaactattgctggtggtttagtaggtacccctgcatttatagggtttggtagctcagcaccaggaatatcaatcattggtaatacaattgatttaaccaatccatctggcacgttaacaaactttgcttttacaatgccaagagatggagtcatcacttcaatcgatgtattcttttcaacaacagcagcattatcattagtgggaagtacaattacgattgaagcaaaattatatgaatcaattgctccaaacaacactatgactgtagtgcctggaacaactgtaacattaactccttcactaacaggtgtaatttctataggaacgatttctaagggaatattaactggcttaaatattaatgttccggcgggaacaagattaatgcttgttttaactgcacgggcatctggattgagtttagtcaacactgttgcaggttatgtaagcgcaggtgtagcaatagactagctaaaaaaggagtctctaataacttataataaaaaatatagtttttgtgaaatgtaatatttatgattataggtatctcgcagttaaaaagttcttattaaaatgaagtgcaccccaaagtttgatatatacttggaatcttggacatgtatattcaaatgaaaggggtgcatcttaatatgtaaaaattatttaaataattcgtttataaaaatatttttaaaatcataaaaagtgttttatagataagaatataagactatgtcaagtattatactatttaaataattacaatctaattaaagggagtagtttctattcaattcagaaattactccttaatttatattagtatttaatttattgcagaaatcttttatttctgcaattgataagtttgattacacaaagtgttagatagccgcaaaaagtatttttattttgaattattagtaatattgggagttctcttataatctaattttataacaaaatattaaataatagttttttattatattattgagatataagaattattttctagttttagtatttacatatttttgtgcaatttctttgattgtttcaaattgacctttagctgccagtttgtttaactctcctccaatgccaatagcatcaataccagcattaaaccactcagctgcattatttaggttaacaccaccagttaccattaaggaaacatacggtaagggccctttgattgcgttaatatagttaggaccaaaagcacttcctggaaataatttgataatttcacagccatattccatagcagtaatgatttctttaatggtcatacagccaggaatataaggaataccatagcgattacaaattatagcagtttcttgattaaaagctggtgatactatatatttagctccagccataatagcgttttttgcagttggtgcatctaaaacagttccagcaccaattaaaacagtattattattttgataatcacttgataattgtttaataatcatgtcagcattattgttagtataagcaatctcaatagcttttaaatttcctttaatacaagcggtggctgtttggtgaccttcttcataacttgttcctctaattactgcaactacaccttgtttttttaattcaataattgtatttgatttagtcataattttctcctatcttgatatttcctgttttgattttaataaattatttattcattaaaatcaatttataaagtaataatatttctagctaattagtaacatcgacttattactaactttttttatattcagtaatatagatttatcataacttgttaataatatttatgcagatatttttataatactgcataaatttaggaggttttagtttatgacaaatatttatggttatgcaagagtttcttcaaaagaccaaaatgaagcaaggcaaattattgctttatcacaatttccagtaaaaaaggaaaatatttatattgataagtttagcggtaaggattttgatagacccaagtacagtgaattaattaaaatattgaaagagcaagatattttagtgattaaagagattgaccgtctaggtagaaactacgaagaaatcttagagcaatggcgagtcattacaaaagaaataaaagcagatatcgttgttttagatatgccactactaaatactagaacaagaaaagaaaatcttacagggacatttattgcagatctagtacttcaaattctttcatatgtagccgaaaccgagcgacaaagtatcaagcaaagacagcgtgaaggaatcgaggctgctaaaaaaagaggtgtaaaatttggtagaccatgcattcctgttccagaagagttttatgatttaaaggaaaaatggttaaataaaaaaatcacctcaagggaagcagccactactattaatgtttctcaagatacatttttaagatgggttcatttgaagtgatgattattatgaaaatagtagacttattcattcgaaaagataaagctttatttttaacgaaaaaactataaaaacacacaaatttctttctactatgattaattttgatgtactatctgtcaattttcattatacatttgttgaacgataaagtctactttatgcggacgaatttgtactatgtgcaagacaaatataaacacaattttacattattagtactagaattattgaggagggatgaacgaataaatgaggacacagttatgttgttcaattataaatttgtttatctgcttctaagcttaaagtaaattcaattaatgaaaaagactaaaagtctagttggcagaaaatacggtaaattactcgtcttggctgaaacaaataaattagaagctcgatataaagtatgggaatgtagatgtgagtgtggagaaataacatttgttaatacaaaaaaactgaaacgagggacaatcactaattgtagctgtattcctaaaaacaaggctaaaaaaggacagaggtttggcgacttatggcaatttctccaacagaaaaaagaacacagaagttagtgaaactgggctaatgcacgggcagtatgtcggttgtgggtgtagaaaaaagagattactgaaagtgtttataataatcttcatttggttgatggtacatgtatagagtttattaactcacaaaaattaaaaagaaataatactagtggagcatgcggtatttataaactgaaaaataataaatatcgagctagtattggttttaaaggtaaacgttttgatttaggaacatattcaaatttcgaatcggctctagagactcgaagagaagctgaagagctggtttatcaaacttttattattgcttatgaacagtggaatttaaaggctgctgatttagtctggttccagaaaaatccgtttatttttgaagttaataaggtcaatgggaaattacaaatcaagcggagttaggataaagagaagaaatagatatatgacttgaaaggatggttaattatgcaaaaagatatttttgaagatgctgtaaaacttatgcggtgttactttatttcagatttacggattttgaagaaagaagtatatgaaatgctgtatattgtggattttaaacaatatgatataccgaatttgcagcaattttttgcttatgtttttgatcgagagatttcaagttatgaagatatagaagaatttttatggaatgaatcaactttataaataataaaccatctcttgattctaagagatggtttattatttagtgattatttttttgatagtaatataatgagtatagaaaaagtaaaatacaaaatataatatagaaaataaatagtttattttgaatacctccagataggataatcaatgagccgatcgttgctaaaatcgggcaaactaaacctttaaatttactcttaatttccttatcaagatacattttaaatacccttatatataataaagtatagaagatataggatattccgatagctccctcagatacatcactattatataataggttgtatttagtacataaataatggacgaacatccaaatcgtacaaataatcaagctacagatagctgaatttaagggcatttgaaaacgtttatcgattttacgcaaatgtttagaaaagggaaacatatttttacgtaaagataatgaatatggcatgcgaatatagccaatgactaaaccattaacagttccaataaccgaaataactataaaaatgataatcattttactaaaggctggaccaaataaattttgtgctgccaaactgacatgacgatctcccaaagtcataactacttcaggtgtaacataacatgagataccaataaagtataaaacatagatacttaaaacgattaatgggcctagcattaatgctttaggcatatttttcttagcatcttttagttcatgagatatagaagttgttacgatccagccatcaaatgaataggcaatgggaccaagggcagaaatccacccagtaccacttagtgtattgatactagtatttgctaaaccattaataggatcaccaaaaataattcccaatattcctaaaataaataaggggagcagttttattagggttgtactattttggataaaagcaccaaattttggtaaaagaatattgtaaacaaaacaaagtagtaaaaagatataaccaattaaaatttcaaattctaaactggcttgtaaattaaataatatgtttatataaactccaatgacccaagctacaacagaagtaattgtaggatagtaaacaaaggtttgaaaccagcccatagcacatgcaactttacgagttaaaaacatttcagcatatgagattagccctccaactttatcagtgcgagatgctaattcaccgattgtaagacaaccaaaaatgattgaaattgcggctaagataaatgatagcacgcctagtgcaatactgccgtttgtagcaattaaaacattatcacttttaaagaatatacccgagccaatacaaattccaacaatcattgtaatggctgtaaataatccatatttttttgttacatcattattattgttattcattttaaatctcctctaacatcttgaaatattgtactaaaaactaaacaatattaaaagtaatataatttattattttagctgctggaaaaaatatttaaaaagttaaatatgatgaatgagtaattttaactgggatagtttttttgtgtaatatttgcttattcttataagcatgataaaatagttaaaaaggagagaatgatgatggtaaaaaggtgttcatgggtagatgaaaagtcagaaatttataaaaattatcatgatcatgaatggggtgtaccggtttatgatgatgaaaaattatatgagatgttcttattagaaacatttcaagcaggattatcatggataactattttaaaaaaacgagaagcttttagagtggcatttgataatttcgatgtaattaaaatagctaactatgatgataaaaaagtaatggagttattagcaaatgaaaaaataataagaagtaaacgaaaaattggtgcagcaattaataatgctaaaatttttataaatattcaaactgaatttggtagtttttctgactatctttggggttttagtaaccatcaaattattaaaaataaggataataattttaaaacaacaacgaagttatctgatgatatttcgatggatttaaaaaaaagaggaatgagttttgtaggctcaataactatttattcatatttacaagcaataggtattgttgatgatcatgaattagaatgtttttgttataagcattaaatggagctggttttatggggtaagtattgtaaatgaaaagaaattaactgtcatggattttactggtatttatgagttagaaagtttttataagcataaaaatattaattggattgattgtttagatattaaggggacacgtggttattgcagtgaggaggcaaaagcgaagatcattaaaagaataggtgattatctgcctgcaggaatacattttattgattcaggtaattttcattatgtaagtgaattttggataaggaagataaattatgattttattttaatagtctttgatcatcatagtgatatgattaaaccgatgtttggggatattttaagctgtggatcatggatcttaaatgctttaaaagataatcaatatttaaaacagatcattttgattggaattgcacaagaacaagttgatttaatcgatcctaagtatagggagcgcgttatttatttgtgtgataataatcttggtgatttaaaagtttggaagataattgatgaacttttgaaacaatatcctgtttatttttcaattgataaagatgttttaagtgaacaagtagtcacgactgattggcagcaggggcagatgcggttaattgaatttaaattaattttagcagatttaattaaacgtggcgatgttattgggattgatatatgtggtgaatgttgtaatgaagttgccatgttaagtgagataaaaaatgatgattcattaaatgcgcaaatcttagagtttttaaaatgtgaattggtaaaataggagattattatgtgtggcagatattttttagaattaaaagccttgatggaattggaagaaagaattgactatacatttgaacgtgatttattaattgctaaagattattatccaagtaatattgtaccaatcattattgatcgagataataaattagaattaaaaaaggcaaaatggggctttagtacttttgataataaattaattattaatgcgcgaagtgaaactttattggaaaaaccattctttaaaaaagaagtgattactcatcgttgccttattccagctagtggcttctatgaatgggacggtcataaacataagttcacttttgaaaacgaaaaacgatcgttattgttaatgacaggaatttatcgaaatgttaacgggcaaacagaagtgactattgttacaacaaaagcaaataaaagtatgtgtgagattcatgatcgaatgccattgattttagaggagcatttaaatcatgactggttagaaaatcgtcatattgaagcacttttaaggacagtaccacagtctttgacgattacttcaggttttttgcaaagtagtttattttaggcatatgatttgttattttgatattagaacagtatacttatggtgtgcctaatacaatattatagagtataagtttgattattattagagctatagctatgaagttgtacacgactagctatagttttttagtttcgttaaagtaactaggttacaaaaaagtgccttctttcatataaaaatcaactagtgtatattaaagacgagcggaggtaagagtgatgaaagttaatgattatttaaatgaacttagaaaaataaaagatgtagcaatggcaactgtagacagtgacggctatccacaaattagaatcatcgatgtaatggctgtggaaaataataatttgtattttttgactgctcgggggaaaaacttttatcaagaattacttgataaaaatttcgtttcattagttgcgctaacaaaagattatgcatcgattcgtttaaaaggaaaagttaaaaaagtcagtaatcaaaaagaatggttagaaaaaatatttattgataatccgagtatgaatgaggtttatccaggtgatagtcgtaatattttagaagtattttgtatttttgatggtgaaattgaaatatttgatttatcaaaagtaccaattgaacgttcacaatatgatctttgtgataatcgaatttttaataaaggatatctaattagtaataggtgtattgcttgtgatcgctgtaagcgtgaatgcccacaacaatgtattaaaagtggaagcaagtataaaataatgcaagatcattgtttacattgtggtttatgttatgaaaactgtccggtgcgggcaattgagaaagtaggttagattatgttaagagatatgctatctttattacaagaaaaaggggatttctttttaaaattattaattgaacatatgcagatatcgctaattgcaattattattgcgactgttataggcttgattttaggagtaataatcagtgaatataaaaaaagttctaaaacaattttaggaattattaattttatgtatacgattccctctatttcactattaggttttttaattcctttttctggaattggtaatagtaccgcaatcattgcattaagtgtttatgcattattaccaatggtgagaaatacatatactggaattattaatattgatgataatattattgaagctgcaacggggatgggatcaacacgttggcaaattttatacaaaatcaagttaccgttggcacttccagtaattatgtctggttttagaaatatggtaactatgacaatagcattagcagggattgcttcttttattggtgccggtggtttaggggtagcgatatatcgaggaattactaccaataacacggcaatgactttgacaggtagtttattgattgcaatacttgcattaattacagatatagtattaggctttattgaaaagttatttaccattcgaaaagctactttaaaatctaaaagaaagtatggcttagtagtaattgtgacaacttgtgcagtcttgatcatatcaatgatttcaggcaatcttaatcaaacagtaactttaaatattgctactaagcctatgacggagcaatatattattggagcaatgttgaaagaaatgattgaacaagatacggatattaaagttaagattactcaaggagtaggaggaggaacttcaaatattcaaccaggaatggttagcggtgagtttgatttatatcctgagtatacgagtacgggttggaatacagttttaaaacatgaaggtttttataatgaaacaatgtatgaacagctagttaaagaatatcaagaaaaatatcaatttacctggacagggctgttagggtttagtgatgcatatggtttagcagtaagaaaagagattgctgagcagtataatttaaaaacttattcagatttagcaggaatatctaatcaattagtttttggagctgaatatgatttttatgaaattcctgagggttatgatgcactatgccaaaaatataattttacttttaagaatactatggatttagacattggtttaaaatatcaggcaataaatgaaggtaaggttgatgtcatggatgtctttacaaccgatggtcaactatcaacagcaaatgttgttgtccttgaagatgatcaacaattcttttcaacttcgatgggggccttagttgtgcgcaatgaaattcttgaacaatatccagaattaaataatgtttttgataaacttactggtattctcaatgaaacaaaaatggcacaattgaactatttggttgaaacaaaaggacaagatgctgaatatgtggctcacgaatttttagttagcattaatttagtgaaataggaggaacatatggatacagctattgaatttaaacatgtaaaaaaggtttatggtgaaaaagtaattattgatgattttaatctaaaaattacacctggtgagtttttaactgtagttggtagttcagggtgtggaaaaaccactattctaaaaatgatcaatggtttaataattcctgatgaaggacaagttcttgtacatgatcaatgtacacaggcagttgatttaattgaattaagaagaggaattggttatgcaattcaaggaagtgtcttatttccgcacatgacagtagctcaaaatattgcttatgtgcctaacttattaaataaaaatgataaaaaaagaacttatgaagcactatcaaaatggatgaaaatagtagggttagatgaagagttaattcatcgatatcctagtgaattaagtggtgggcagcagcaacgagtagggattgctagagcactagctgcttccccagatattcttttaatggatgaaccatttggtgctgttgatgaaatcacacggtctactttacaagatgagattttaagaattcatcatcaagaaaatatcacgattatttttgtaacacatgatattaatgaagctttgaaattaggtagtcgggttatggtaatggatcaaggtaaagtcgtacaattagcatcaccaagagaaattttagaacatcctaaaacagaatttgttagaagattagttcagcgtaaagacgattttcttcaataacagccttttgggctgttttattttactaaatcgataaaaaagtaaaacaatcgattataatgaaagtataaaaaataattattaatgcacccgttgaacgtttttaatcgtattcatagtggaagggatcgttatggaaaaagaaagatatgaagaagttgtatatcagtatagtgacatggttactagaattgctgttatgaatgttaaaaattatgatgatgctaaggattgctatcaaaatgtatttatgaaattatactgttacaacaagaaatttgaaagtgaggaacatttaaaagcttggttgattagggtaactatcaatgaatgtaaagattatcaaaaacaattttggaaaagggaaattgatattgataagttgattttaggtcaagaagatcagcgtttaattattctaccaattgtaatgaatatgccaagtaaatatcgtaatgttttatacttgtattattatgaaggatattcaactaatgaaattgcatctattttaaaagaaaatcacaatacgataaaatcacaattaattaggggaagaaaattgttaaagaaaaagttgggagatgatttttatgaataaatttaatgaatttgacttaataaaaactcctagaaactggatcgatgaagtgactgcaactaattttgaaccgacaaaaagagcgaaggtgattagaattaagtatatatttgcaattgttttaattgttatgacaataggaatttcttcattgggaattacttatgcattttctgattcatttcgtacttggttgagtcagcgatttagcagtaatttgaaaattagttcagctcttgaattttcttcaatcaacaaaaatactcccacactaaaattagattatgggcattggcgtgctgaaaatgaattttttggaatcattgatgaggattataattttcttaaagtttttacgttagaaaatgaacaaataagagaatgtcctattaatgagtattacgggagtatagctggtcaggaattcagttttaaatatgcggattatcaagagcgaatagttgcatttgattttaatggatgtatatatagtgttttgcctaaaattattaataatgatatttatgtttgtgtcgatattaatgatggagagcagcgtgctttaaatattgctaagattaatttagaaagtaagcaaataagttttattactaatgataatatttcagtaaatccaattacttcaccacaacaaactaatattttaattaataagagtgatcaggggtgggaaaattataatattgaaactggagaaaccaatctcattaaaaatatcgatccatatatgcatagtaattgtattacttttattgatgaacagactgttgttacttatgatgaaaatggacattcttatttaattaatattttaacaaatgaagttagaacgttagataaatatcctttggaaggaacgattgtcaatattgaatatagtgatgaaacgattaagttaacaaatattattacaggcgctgtttcaagaattgattatcatttttatggtactaattatatgggaacttattgtagcatagattatcttgttttatttaataatgaaaaactttatctttatgatattgaaagtaatcagttagttgatttggatccacaaaaagaattagatgagcaattaaaagaagtaatgatcattgatcaaaaacatttattaattactacagataaaagggcatatatagttgctaatgtagggaataatggataaaatataagttagtgtagtggaggacttatatgaataaaaaatatattttgtttgatttagatggaaccttaactgatccgatgaaggggattactaaatcagtacgttatgctttaaattattatggaatcgaagttaatgacttaaatgatttgctaccttttattggaccacctttaagagattcttttcaagaattttatggttttgatgctttaaaagccgaagaggcagtagttaaatatcgcgaatatttttcaaccaagggaatttttgataataaagtatatccgggaattgaagtgtgtttgcaaactttgaaagatcagggaaaagtattgttagttgctacttcaaagccagaaaaatttgctaaagaaattatagaacattttggtttagctaagtattttgattttgttggcggtagtgagtttaatggacgagaaaaaaaggctgaagtaattgattatgttttaacagcaaatatgattgataaagatgaagcgattatggttggggatcgaaagcatgatgtgattggagcccatgaaaatgatttaccttgtatcggagtgttgtatggttatgggacaaaagaagaattgatggcttgtaatagtgattatttagttgcggacattaatgcattgcaagaattacttggataatggaagaaattactgtttattctttggactattatcaaatgtccaaagaaataaaaagagaaattgtacatcttttacatgttgtttggcctagtgatgattgtaatgatgcccataacgaagaacttacagtgcagtcattctatatcatgaaagataatcaggttgttagttacggagcagttcttcggatggaaacaacgatagataatgaaaaatatcaaattggtggattgagttgtattgctaccttgccaaattatcgtaggcagggattaagttcaaaaatagttcaaacagcgactaaatggattgaggataatttagattttggaatttttacgtgtaaacgagagcttgaagatttttatgcttgtaatggcaaatggcaggtggcaaataatgttgttttaattgctaatcgtgataataatgctctatctagtaataaacttgcagttattgtactaatacgtcttttttcaaataaagctcaagttaatggacaaaaaattttaaatgcgagaatttatctggatttgcctcaaggtcaatttatttaaagaaagggttgagtaatattgctcaacccttatttttattactgatatgcttgatccaaggcattttttaaatcactaatcaataattcactatcttcaagtccgatatacatgcgaagttgtcctaaagatagaccacgttcttttatctcattaatattgtttcctttataaactgacattactaaactttcaaaaccaccccaactataggctaaagtaaaatgttctaatgaatcgataaaacgtttaatgatttctggatttgcatcttttaagacaacccctaataaactaccatatcctttaagatatttatgagcaagttcgttttgttgctctccgttacaaagaggatgataaattcgttcgattcgaggatcctcttgtagaaaattaattacttgttgaagtgtttcttgttgtgattttagacgaaccggtaatgttcttagaccacgaagtgctaaccatgcattcattggtgacatcgttgcgcctagtaaaacttgtccaaattcaactatttcatcaataatttttttgctggaaattacgactccaccgactatatcactatgtccaccaatatatttggaacatgagtgaataacaacatcaattccatgaactaatggattttgtaataatggtgttgaccaagtattatcgattatcgtgaagatacctttatctttgctaaatttactgattagttctaaatctaacatctcaaatttttgtgatgatggactttcaaaatagatgatactggtattgtttttgacataatcaaagatttctaaagtatcactgacatcaattttagtactttcgattccaaattttgataattgtttgattaatttaactgatgagccatagactgtattaacaatgataatgtgatcaccggcttttgctaaggttaaaattgatgctgaaatagcgcccattcctgaggcgaacatttgagctgcttcgcctttttctaaacgtgctaattttgtttctagtaaattaagtgttggattcccgtcccgtgtgtatgtataagcaaattcttctttagcattcactttcacatagtggtcaaaatttttaaatttaaatgatgatgttaaaacaatatctggactaattggactatagttgtcgaaatctaactcatcaacttctaaacatacattttcaatatctttcatattcgttctccttacagttaaatcttaaccgacaaaatggcgaatgtccattttttttcatatatggcaaaaaaagaatgtacataaaattgtacattcttattgccatgggttaataatatatttacctttatttcttaattctggttttgaaagaatatcggctaatttatctaaactgcaaatatcacaaaccattgaactaacatcgatttttttactattgattaagtctaaagctcgttgttgagtatatgggttgatgaaagaagctttaatttcaatttccttttggaaaatttcaaatggtttgatagccacttcatcatcaggtttagttagcccaaacatcattactacagatttattaccagctaagctgattgcttgtttaattgttgcaggtagaccagcacactcgataacagtgttgatacgatgaattcctttatcagctaaaagagctggaatattgtcattgattggatcgacggttaaagtagcacccatcttaagccccatttcacgtttaacagcaactggctctgacaagataatttcatgagcaccagctaattttgctaattgaaccattaacaaaccaatcatgccaccaccaataacaagaactgtactagccggagtaatgttgcacatgtcaagaccatgtaagcagcaggcaactggctcggtcattgccccttcttcaaatgatgttgtatcggctagtttatatacttgagattcgttgactgcacaatattgggcaaaaccaccatcccgtgttgttccgataccaatcatatcttcacaaaaatgaccaataccactacgacaatagtaacaagttccgcatagttgattaggatccacacagacacgatcaccaacttttacatgttttacttcatgtcccacagcttcgacgattccagcaaattcatgtcctaaaatagtaggaggagtagtatttgctgctcctttatcaccctcataaatatggacatcagtaccacaaattccacaggccataactttgattaatacatcttgattacctaattgtggcatttctacttcttcaaccttaatatcatgttttccgtaaaatactgcacttttcatttttcttcctccagacatcttatataaaatagttttataaaagtatttaatgtaagtataaatgatgattaatatgatgtcaacggttttaaaatatattatttttttgagctaactctttgatgtaaagttgaaaacaaattagagaccttgaaaaaggtctctaataattatatttaacgattatcaattttctcaggatataaatcatgattagctaaacggttgaaagcaatggtttcccactttgtttctggttttccataattacaatatggatcaattgaaatacctccacgtggtgtaaattttccccaaacttcaatgtatttaggatccattaatttaatcaggtctttcataatgatattcatacaatcctcgtgaaaatcaccatgattcctaaaactgaataaatacagttttaatgatttactctctaccatcttttgattaggaacataactaatatagatagtagcaaaatcaggttgtcctgtaatggggcatagactagtaaattcagggcaattaaattttacaaaataatcattttcaggatgtttgttatcaaaagtttctaatacttcaggggcataatcatctttataaacagtgttttgattacctaataaggttaaattttttgtcatttttattctcctaataatggatctttgattccatttttcaaaaaagcattttggcggtcaatacaagtaccacatgtgccgcaaggggtatcatttccttcgtaacatgaccaagttaattgataaggtacgcctaatgaaagaccgattttaacaatatctgctttggtcatttcaacaaaaggggctttgatttccaattgatggccactgccttcataaatagcttggttcatcgcattattaaaaactttactacaatcaggatatgcgcttccagctgcatcatcactatgagcaccataataaataatattacagcctttagaaagggcaatgctagcagcgctagataaaaataaaccatttctaaaaggcacataagtagaaacaggattgccatctgttttatttaattgctcattgtacgattcgtggggaatctcattatctgaatgttgtagtaatgagcaattactataagtgaagatttttgctaaatctaaatacaagtgttcaacttgataaaattgggcaattttatttgcggcttctatctctttggtatgtttttgaccataactaattgaaagagcaactacattgtcctttccgtgttcttggattgccagtgctaatgcagtggtggaatcaactccaccactaaataatactaatgctttcatcttactactccttaatgtaaataaatttgcagcttactatcagttttaaaacgaccggttagagtacttgtgacagtagtgctattaacttttttgattccacgagatgacatacagctatgtttaccttcaatgattacagcgatatctttagagtttgttactagactaataatttcagcaatatctgttccgattcgttcttgaagttgtagacgtctcgctgccatatcagcaatccgtgcaattttactaagaccaattactttaccacaaggaatataagcaaccgtaactttcatgtcatacattaaagcgaggtgatgctcgcaataactaaagatatcaatatccttgattacaacaacctcttgattatcgaagtctaaatcgtcaacaaatgttttatcaaacatcgttgcaatttctagattactatagttcattccagcaaaaacttcgccatacatcttcgccactcgtttaggcgtatcttttaatccttcgcgttctggatcatcacctaaggctttaagaataccgtagatgtgttcctctatttttttagtatcaatcattttagacacctctttgattaacatcccaaatgaatttgtgcatttgtagttgcatattaataccatttagatgatgtttgaccatataatcgacgatcatccgtggttcaatcttaccaaagactgggctaaaataaactttggtacgattgacaaggtcataagtatcaattatttcttttgctttatttaaatcactgagattgctaactacaaatttaacaacatcatttttagtcaaatattgatagttatttaagcacatttcattttccattgtactgctaggtactttataatctaaagtaaagattggtcgagtttctttaataaagggtttaatatcaatactaccattagtctcaatttcaacactaaaaccatttttaagcagtaaatcaattaaataatcaatattttgttgaagtaatggttcaccaccagttaaagtgacattaacgactttatttgtttttaaataatctaggatattttgagcacttaaaagttcataattgctatttgaatcattagcatacctagtatcacaataactacaatttaaattgcaataatgaaaacgaataaaggcggctaattgacctgcacgacttccttcaccgttaatactaataaatttttcaacaaccttataattattcataatttacctcgataacttgcacagttatttggggtttcatatacatcaagacaatcaactaaataatttttacttaaagcctcgtaaatatacttagctaaattttcagcagttggacgaaatggtaagttgattattttgaaattttcatcgatcagtgcttggtatagtttttctgataaactgcctgtttcaataattaaagcatgatcaaaactatctgcgataatttttaaatctttttttaaatctccaaaatcagttaccattcctttattttggggatcttctagcagtttttcacttttgatagttgcaatgactttccagcgatgaccatgaatattagcacatttaccatgataaccagctaaaaaatgtgcactatcaaaactttgttccgtttttaaaaaatacatctttcctccttctataccatcaaataaaaaagcaggctcactaaaaagcctgcttaaaaacaacataaaaagcatagccctagttttgtttatagacaggatggtacaaatgaactgtctatagtaatagtatcttaaattggaggattgtcaagaaaattgaataaacttaataaaatgcgtaaaaatatgtaaagaaaagttaagaatttgttaacaatctttgcagtatgtaaattttatgttaaagtaaccgtgtaacagggggaataagatggaacttacagatttctttgctatgtttggtggtttagcgctatttttatacgggatgacgatgatgtcaaatggtctcgaattagcagctggaaacaaaatgaaaacaattttagaaaaacttacgacgaatcgctttctaggcgttggagtaggagcagttattactgcagtaatccaatcatcatctgcaactacagtcatgactgttgggtttgttaatgctgggttgatgaaattggaaaatgcggtttgggtaattatgggtgctaatatcggtactacaattacaggtcaattgatcgcaattgatattacagctttagcaccagttattgcatttgtcggtgttgctttaattgcttttttcaaaagtaaaaaacttgatgcaattggtggtattattgcgggactcggaattctcttcatgggaatggaaatgatgtctagtgcgatggtaccgcttagaagttcaccggaatttgttaatcttgtcactacgtttgaaaatccattaatcggtattttagttggtgctggattcacagcgataattcaaagttcttcagcttcggttgggattttgcaagctttagcgatgagtggcgtaattactttaccatcagcaatatatgtattatttggtcaaaatattggtacatgtattactgccgttttagctagtattggaacagggcgtaatgcaaaacgtacaacgatcattcatctttcatttaatattattggaacgatcgtctttgtttttattagtatgttaacaccgtttgcatcatttatgcagtcattgacgccaacaaatattccggcacaaattgctaatgtacatacggtattcaatgttgttacaacattattattactgccattcggggcgcagttagttaaattgtcatatttggttttacctgaaaaagaaggttttgaagataaattatctgttaagttcttggataatagtatctttaccaatgattatcacattggaactagtgcaatcgctaacacacaattatttaatgaaacacaaaatatgttaaatatagttcaaaaaaatgttcaaagagcttttgatttaattattaagtatgatgaaaagacacatgaaaaattattaaaagatgaacaatatattgattatttaaacaaagaaattattcagtttacaaccaatgctatttctaatgaatttccaatcgatgattctaaatcaattggcttattcttaaaaacggctggagatttagaacgagttggagatcatgcggttaatattgctgaacgtgctgagaaattatatagtgaagatgaacatttttcagatgaagcgatgagagaaattaaaattatgaatgacctgacaagaaatatcttagaggaattaaatgtcttaaatcgcgatgaacttcataacattgttgaaaaagttgatgttattgaagatagtattgatattacaacacatgaattttcacttaatcagttaagacgtttgcgagataaaaaatgtacgccggaacatagtgcattatatacagaaacattaattgattttgaaagaattggtgatcatggtttaaacattgccgttgcttttgatgaaataaaagatgatttaacagaaatggcttaactagctgcttatgcagctagtttttttattctataggaatttggattcgtctgataataacagtatatcattccaactaaaagggtacctgatttatggtacccacactggctgagatgatctgcgctttgatatcatgcgttttgaatattgcggcaatatctctgatcagctgcagtccgcccatcgagatatcatcgattcttccaacaaatggagaaacataagttgctccggctctggctgccaggattgccttttggactttgttgctttaaggcaactcatccgcttaatatgatttgttatttagttcatctcctttgagcaacgattcgctattacttctgctctcccacacctcacgatgtgaaacttgcaaatcactatatgattcgtcgacaactacgctcacgagagactttcaccctagatatatggcatgcccatcacacttaaaaactgttgacttttctactttgccgtcaatttttaatgtttgtttttaaataaaatcagcgcctgctgcatcttataagtacgataaaaatcagtcaacatcataataactacataccctaaacaaaataacatgtataaattagtttttataaataaacaaacgatcattccaatagctatcactgttaatgttactttaggatattcaattaaatcaatgattagataatgccatgcctctaaaaaaatactgattaaaagggccaacaaaaaatataatataatcacttgaaaatcagtatttacaatcactgtaggagtaattagatgcctaaataataagatataaataaagctcaacgatagatttatgcctattctttctagcacttcaatcaccttatttctaacctttctttaaatttcttcaaataacttcttgttaggactagcatgattccattttgcatatacaaggtataacgagaattcagttcaggcagcatatactcaatataattaatatttacaattattgacctatttatccgaataaagctatatttatctaataattgctctaattcatatagtttataatgacataggtactgacatgtctgtgtgtttaaatagacctctttagaaaatccttcaatatagacaatatcttgataattaatcctatatatcttctcagcaagataaccaattaaataccgttcgagcatctcatttaaatcactttcaacactttttaaattattgagtgtaaaagtataatgtaaccctgcatattctattccttgttccactaaaataatatctaattcttgataacgagcaaaaaatgtttctaatttttgacgatgtttctcattacatattaatttcaattttttagctccaattgatataacaatgttttgcttttattattttcatcatatagaattatttttagctcattatcgtttttaattagtataacacatggtaaaccagaaatataattgttcttaattttttcattataatacagctgatattcatgatttccctgaatcaaatatgctttcagtattttaaaattagtattttttaaatgaatgtctggtttctttaatacattattttcactagtaatatcgatagtatcatccggcaatactgaattatcattaactttaatactcacttgtttagaaatttcaatgagttcatcacgaatataaatacctgggtatgcaacagttttagtattggtcgttttaagtgttcctgttttattattactctcattccaaatagaacaatattcaatgatcacatcatcatttcgataagcataaatcgcataatttgtaaaaacacttcgatcctctaaacgatacattatcggatcagataaaaaagttattccacctatactcatgatcaaagctatgattgcaattagccgatatgttttctttcgtgggtgaactcgcttgattaaaattttcgtatatcgctcacttaaatactgatttatcttatttaagtgatacgtaatgcagcaagccttataaaatatatatccatagattccaatcatagaaaaccatagtaacgaaacgaataaaatatttaatatcggaaatgataaaataaaattgataattataaagtttttaatatgtttttgatatttttcaatttcaatataatcgctacttattctctcaattccttttaatacaaaatataacattgcaaaactaatcaatcctttaacaaaaacaaattcattaaaatcaataccttggttcaataaaaattactatacataaagctattgttaaaattaatgcataatcaagatacttttctcttaaccgtttacggatacataaaagtcctaaaatcatcaaaagagccgaaatataggcaggaattaaatttacatcattgatcgttaatttaagaccatacataaaaataaatgctaatgcgattaaaccaattcccataattattacctctctctacttcaagtatatctaataatttagattgtttcatgccttttggtctaaattgcattaaattagcctgaattacaaaaaaatcacagtaaatactgtgattaccaacgttttataattacatgcagcttagctagatccatctctaaaattttaccaatttccttttttaaataaacttcatttaattttgtcttggcaataaattcgttattattcttttcaaattgagctaattttttaaatctctcatcttcacataaatcataataatagccatcgtcaaatgatacaactaaaatatactcatgtggttctttattactacggtgactataccaatatacaaataataagattaaaatgattgcaaccgccccaataatataataaatattcattcttctacctccgactatatcaatttaactaaaaaaactttaccttattattagtaacaaatttgactttgaataatttttttacttaatcatctaaattataacattttataaaaagaaaatcccgtagaataataacattctacgagatctgggaagtaattcatttactatttatattctatcatatgataagtattttttctaccaatccagctttaaaaacaaactacccttttagtttattccgctgctccatttctctttttactagaatactttcataattatctattttatgctttaaatagctgatgatcgactgtaattcttcaacttgtgcttctaaatttcctaattgttcgatcataatatcttttctttgagaaatcgtatgctctccttcattaaataaatctacatacaactttatttgctcaattgtcattccagcagcccgcatacatttaataaaattgattcgacgcaaatccggttcctgataatctcgatgaccactaatattttttgctacaggattcattaatccaattttttcataatatcgtaatgttgtcgaactaatcccaaattttttactaacttctgcaattgtcattttcatcaccctctttatataattataagtcataatttgtagaccttcaatttttattttaaccgataaatcttcatttgagctaagcaaagaatgacaccaactatttgcattaatgccccaagataaaaaatcatccgataaccactaaaggcagcaataattccccaaacaactgaaccaattgcatacccaatatccattgcagcataatatgtcgcattagcaataccatttttactttccggcattcgcttaattaaaaatgtattaacaatcggggcaacagctccagttgcaaatccagcaggaagcgctaaaaacaggagttggcacatcctagttacttgaccaattaaatatacactaataaaaaataataaagaatttaataacaacattttgaactcaccaaaatgaataactagtctattcataataaaacgcgaactaatcattccaattgcatttactgaaaaaaacattcctgctccagcaaatccaagactaattgcatatagagaaacaaatgaggtaattgcactttgcgtcaaggaattaaagaataatactaaaatcggaacaattaaaataagccaattaatagtttctttctctttattttgattttctatgctaacaattgatacatctttacccagcagcattaacccaaaagttaaaatacaaattaataatgaaacaataaaaagcaatttaaagcgatcataattagctcctaaaatactataagcaatcgatggtcctactacccctgttaaactgttggcaatagaagcataactaaccccttctaataatcgattaggatgacacattttggcaacatatgtactagccccagttgaagctattccaaacccaatcccttgcattattcgataaataatcgccaattcaatttgcttacagtcaataaagaaaaatgctgcagccatcatcaacgttataccacctaatattacttttttacacccaaatttatctaacaaaatacccgcaataaaacgaacacacaaagctgccaaagtaaaaattgatgtcatcaatcctgcgtatgtatctaatccagttaaatttttagcaaaaattgttagaaccgacaatacaatattggaacaaaggcatattgcgaaaagaattattactgataatagatacttttttgtccaaagtttttctttcacgactattttcctactcgtttagcattatcagaatttggatcccaacgttctgcctttaaatccatattatctaatgctctttttatatttttcaaatcaacctcatctaaaataactttgctggctttaatattttcttcaatccgacttagctttcgacttcctggaataggtacgatccaatcaccttgagccattacccaagctaaagcgatttgagctggagttacctgtttttcttttgctaacttcttgatcaattcaactagtacttgatttattgccatattctcttttttaaatcgtggttgtttacttctagtatcatttttagaaaaagtttgattagggtcgatcgttgctgttaaaaatcctttacctaatggtgcaaatggaataaatcctattttcaattcctttaatgtatcaagtaacccatttttttcaggttctctaaaaatcatcgaatactcactctcaactactgtaagtgggcaaatagcatgagcttttcttattgtttcaacgcctgcttctgataatccccaatgctttatttttccttccgccatcaattctttcattgtttgagcaacaagctcaatcggtgttttaggatcaacacgatgtaaataatatagatccacataatctgtttttaaacgtttcagtgattctgataaagaagtgcgaattacttcaggacgtgcatctaaaacctgctttccatcaatcaccttgattccacacttagttgcgatctgataactatcacggggatagatactcaatgcctgtccaactaaatcttcattatataaaatttctcctgtttcactaacaccctgataacactctgcagtatcaaacattgtaattcctgcttgataagcaccgcgaattacttcaatcatttctttttgatcactcgcatcaccaaaaccatgggtcattcccatacatcctagaccaattgctgatatttcaaaattactaccgagttttcttgtttccattttctcttcctccaatatctttgataaatacatcctaatacttagagtcaactataagtcaatagttttagctaaaaaagaacaactcccttattcataaaattaatagattgtttttcgtaaaatacattattttactcgttttactaaatagatataaatgttgataaatttaagcaaataatcttgaaaaattaacatataatggtacaatacatacggtcttaaatatacaagctgattacagggggaaaagccaatgaaagcattttcacaaatgaacaataatgagttatgtgaattaaaaaaagaattagaaaaaagatatcttgatttcaaagcaagagatttaaaattagatatgtcacgcggtaaaccagctagtgaacaattagatttatcactcggtttattaaaacaagaagattatatgattgatggtattgattgccgtaattatggtggccttgaaggtttaccagcaatgcgaagattctttggtgaattattagatgtaaatgagaaaaatgttattgtaggtggaacgtctagtctaacattgatgtatgactatcttagtcaagctatgttattcggtgtcatgggaaatactccatggtcaaagttagataaagtaaaatttttatgtccagttcctggatatgaccgtcactttgctttttgtgaacatttcggaattgagatgatcaatattccgatgaatagtgatggtcctgatattgagacaataaaaaaacatcttcaagatgaaagtgttaagggaatgttctgtattcctaaatattctaatcctcaaggaatcacatatagtgatgatattattaaagcaattgccagtttaacaccagcagcaaaagattttagaattatatatgataatgcttactgtgttcatgatttgaatgagcatggcgatacccttttaaatatatttaacgaattgcctaaatatcagcatgaagatatggtcatcatggtcgcttcaacatcaaaaatcagttttgctggagcgggtgtatcatgtattgttgccagtgaaaataatattgtggacataaaaaaaagattaacgattcaatctatctcgcaagataaaatgaatcaattaaggcatttgaacttttttaaagatgttgctggtttaaaagctcatatgaaaaaacaagcagttttattaaaacctaaatttgattgtgtaatcgaacacttaaataatgaattaggcggtaaaggaattgcttcatggattgaaccaaatggcggatattttatcagtctcgatgtaatgcctggatgtgctaaacgaattggggaattatgtaaagatgctggtgtcgttttaacaactatcggagcaacttacccatatggaatcgacccacaagatactaacattagaattgctccatcatatccttcagttgatgaattatcaaaagccgctgaactactatgtatctgtgtgcaattagcttgtttagaaaaactattaaaataaacttagcgaaaggaaacttattcctttcgctttttatttcttaattttccaattacagccatcactattaatgtgagagcagtaataatatataaattccccaaaataaaatctaaaccattattatttacatgaatcattagatttggacaaataactgaaaaaattaaaaatactgtaccgaaaaataaaccttttactagactcgctgatacatcattttgatgacatgactctttaatattcatcttcatcaattctttttcatcaatactatcataatagaagattgcatcattattaaattcatcattagcgtaattgttttcaaaatactgccatcccaaattttgatatttacgtttgattaatactaagtcattggaatcaacaatatagatacgttgcaaatcctttttctttttaaattttaatacatctaatcttaaaggttgaaaaagaccaaaaggaataatagtttccaaaatataattatgctgtacttttttatttaaatacttctctagttcctgacttcctaaataaagcttgatcctcatcatttcaatcattcctttcaattattagataatattgcattaactttaacaatctcattaaaatattcatctcgtgttagaccatgtcgatttaaaattttatcgatcttaccatctttcatatataacattttagttgaatacgatgcaacaaatgcatcgtgagtcaccataataattgttgtttgagaatcatggttgattttcgaaaataattccatcaattctctagaattattactatcaagattaccagttggttcatcagcaataattatttcaggtttactaattagggctcttgcaattgccgctcgctgctgttgcccaccagagcactcatatacatgtttatcgagtatgtccttaatacctaaaatctgtgtaacctgctctaaattttcctgccattctttttcaccgatactatttataattaacggaaaaagaatattttcacgaatcgttaaagaataaagtaaattataattttgaaaaataaaacctaactttttctttctaaattttgcctttgctgccccactcatcccaacaatacttgcacctgaaatattaacaattcctgaagttgctttatcaattgttgataaaatatttactaaggtcgtttttccagaaccagaaggccccataatacaaacaaattcattatttttaatttcaaaactaagatcatctaaagcaatttttggtgaaggacctagttcatcatatattttctttaaatttttaacttcaagcataatatttgtcatttttaatttcctcctttctttcatatagaataatcatttctgctaacatataaggaattagatattcagccataataataaaagttgtcattattcccattccctgattaaaataaaagacaataaaaatattaaaaatataaattattgacaatatccaaagatgacgaaaataatattttatttcctgcatataaacaaaatcaatttctgctcttgcaaagccaagttgatagatggcatgaaagtgttctcttctttgtatatgatcaattttaaaacgatttataagcgtcaaactcaataatatattggtaataacaaatgcaagatgcatctcaaaattgaacaaactattatcagtagtcccacaaatgaatggcacgattccgatcattgctaccattaagattaaaataaaagattttgactgttgcataatcaaacttacatcttctttaattaataggtcttttgccgttttgcagtactttaaagcatttctattatagtgatgtggtaaataatgccgaaacactccataggcaccgactgccccaaaaaatgaaaataagatatatccaccaacttgattatttccagtatacatacatattaagccaaatatataaataagaggataaatcccatccggcggttttattgcacgagtatcttttttataactaattatattatgattttcaagtaattctgttattccagtacgcataataaaaccactattaaataacataattaccaatatcatcgctaaaattactgctaatccctgcatcaaagcatcaaaactaaggacaaaaatatttgcatcaacacttaaaatttcgtatatcaccattttaacaattggacttattcccaaaaaaactataattccaatcattgaagaaaaaaggacaatacataatacttgaaccaaactgtatatagttcgtttaaaaaagcttagccctgataagacagttaaccctatttctctagatttaagtctaataaaataattgcttgaatataccattaaaacgacacacataaagatcataaaaaacgttaataacgcattatataaaaattgaatatttaaaaaatctaaattaccactaatctctggtgattttagaatttccataaataataaacaaacagttactgttgaagctatacaaatacataaatcaacagcactctttttttctaactttaataagtgcaatgccattttaatcatctttacaatctcctctttttattaactttgcaaaacacttattaatacttttgctagctcttttgaatatctcagtatatggtgtttttaaagctttaaattgttcatttacaagtttatcaatactatgctcattatcctttaattcttttaatggataaatataactctctttcataattgaaatataattctcacgaggattatctaaattatattcttgggaccaactgctaaaatgtttatttaaatatttatttaacattactggatcatttctatctcgataaattctaataagacctaatggatcattgatcggaacagataatgaaactatataattaaatagattatttatctgactattattcattatttgaaaagaatacgtatcactagtagtatgaatatcaagatcaacataataattcaaaaagaaatatgccttaccatcacacccctttgaactacacatcgataaatcaatctgcataatgtcattacaattaattttcacttcattaaaacaaaattcattttgattaatcaacagaccctcgtattcatgatttatagaattatcaaaaataacctctactttatgccgttgtatatatgctttaattttttcatcaatatcttttaactcaatttgtaattgttcaatatactcctgttttctttcaagtacatatctaattgaaagttcactattcattattagttttatctcatcaatggatatttccattgaacgtaatagtaagaccatttttaatgtatcaagatctttagatgaataattccgataattatttgcatctctttgacaaacaactaagccttctttttcataataaattagtgtttgtttagttatgccaaaaattacttcaacctcgtgtgttgtcataataaaacctcccttctacctaacatttaacactatatactaagaatacagtcaaggattatttatcaaacaactcaattaattgctttttaaaactatttccaattggcaatatggaaccatctaccagttctacgcaatttgcagcgattttaataacagcatgaagattaacagcataagatttatggatttgaataaaattttcatttttcatttggcagacaaactcgcttatattttttctttcaatatattcaccactattagcatgaatatgaatgtaatgtctaaaggattcaacataattaattgaacttattcttactttagaaatagttccgctattttgaatttgataagttttaaatctttttaccatgacatcaccaagctgactcatgagattatcaatatcttctataaatttattggttcgaatataattaaagccttctaactcataacctttttttattagctctaaatcttctaaaccaatcaatacgatgatttgctgataatcctctaaacgaatcctctttaaattttcaatttcagcaatatttttaatttccatcatataaacatcataattaactgcttcttggtaatccatgatttgtagatcatcacataacttaagcagttctatttttaagatatttttgatatcttgattttttattgccattgcgatcctaatcatgatgaaccccgctttcaatttcatcgatatattgagataccatacgtttaggattagcaataacttctaataaattatatggatcattaagcgttattccaagagactcaatatgtttacaagccattacaaacttttgtgattctcttgtataaagtgcttctagttctacagtagtaccatctttcattgtaattgtaaaagttataggatgcccaattaaaccaaaaggaaatattggaacatcatgccaacctaaatcaatcctatccatctgttgaacttttaaagcgaggaaatagctattttgctgtttaggaagataaaaagctttgattctagctgtaaattttctaaacgaactatatttaaatacctcatcatcgatactccaccacattccagagctataaattattggaccagcaataaaaaaattaataattaaaataacaaggcctaaaaaaattccattgacgattgaagcatggtattgaacttcaaatacaatcaacattgtcgcaaatggtacccatatcaacatattgacaatagctaaaatccttcgcggttttccgattacatattttttcacgtccatctcctcctaattttattttatctaattattattaaaatgatatacttatggcacgtattgagatttactggcacaaaaaaagattaatgattctgctcattaatctttaatacgattttttcgatattctaggaaatcattaaagaacatccgaattacacaaattaacggaactcctaaaaacattcccaagaatccaaagagactcccaaatatggtaattgagcaaataatccaaaatggtgatattcctacactatcgcctaaaatgcgcggtcctaaaatcaagccatcaaactgctgtaacgcaaaaatgaaaagagcagtccagattgctggcattatcccatttgttaataatacgataaaaactacgggcaccccacctatgaatggtccaaaataaggaatcatgttggtaataaaaacaacaaaagctaataatgggaaaaacggtaagcccatcagtccaaatccgactagtgcaatcaatccaataatgactgaatcaatgaatttcccataaataaaattaccaaaaatacgatgtgatttaatcgcataaccatgaattaaattcaaattttcttgactaataaaacaaagcataaaacgatcaaaaatacgtgcaagtttttctgcttcaatcaaaatatatggacaaaagatcaagcccatcaaaatagttaataacgtactccccgttttacctgcaaaagcaattacttccataaaatcatttgcgctaagacttttgatagaatcaacaaaagtctgctccacctggataatcgttcctgctaaattaggatcttcaaaagaactatttatcgatgcttcaaaactcttaacatatgtatcaatatttttagcaaattctactgcataatccataaccataggaattaaccaggtcaataacaaaataatcattaaaattactgccaagctcactaataaaacacttaatacacgtctatgctttttcaaaaatgagctttgacagttttcaaacagtttagtcaccatctgtactaacggctctaaaaaataggctagtaccccacctataataatcgggaagcacgcatttaataataccgaaaaccatgatggttcaaataccttataaacaactattaacaaaattccgattattaacagtccactatattgttttaatttatctttttgcatttataattctccttagatagttatcctaattataccataattatgcaggcatttcccctttttattccacttatccaaaagttgctctatatacgacaacgtcattacttcataaacctctttactaactagatcatataaatggaaatcatcattaataacaactaaagttagaccgtattcacttaatttttccaaaataaaaccctcctcaatgcagtttatgcattaaaagagggaatattactcatatacatgatcaaacttaaagaaagcattacaccgccaaatacatcactaaaataatggactcccaaatatatacgacttaatgtcacaaataatataattattatacatccgctgatcaataacttgcgatatttcaacttactatgatacaaataataaataaataatccatatagacaagttattgccattgcatgtccactaggaaaactataattagtttcgttgactaaatgcacaacacttggtcgaggccgcttaacaataaactttataattcgattaagcagctgctggataaatgacgctgctaagcaaactagagcaattcttttactgattataaatgcaacacagattgctccaataatcccgataaaacttcctagatgagttaccataattacaattggtgttactctttcattaatcagtatttgcagcaattgataaacaaaattatcgattggtttaattattccagtcataattagaaaataatcaaggataaacaaagctaatgggattaaaaaaaaccactgtttataattcttttttaactttaacgccattttctttaactataaatgctggtaccccaacaactgtacaattatcagggacatcctttaacacaactgtttgagctccaataatactattattaccaatcgtaacatcaccaataacctttgctcctgctgaaaccatgacattattcaataacgttggatggcgctttactttgtgttcaccagttccaactccacctaaagtaacaccttgatataaaacacaatcatcacctatgatcgttgtttcaccaataactacccccataccatgatcaataaataaacgctttccaatagttgccccaggatgaatttcgattcccgtaaaaaatcttgcaatttggctaaacatccgtgctaaaaattttaaatgtaatttcttccacaaaaaactattgatccgataacaaaacattgcatgtaccccaggataattaataatcacatttaaggcatatctcgcagccggatccgtctctagtactttttttattaaactcctattttccatactctcactccttctagttaatatatcgataaatcatcaataatgcaactaatatatattatatttatgaaattttttattttttttctaggcaaaaattaaacagaactcatcccccatgagttctgtttaaacgttattagatactattatagtgtgtatctttcttcccctacataaatcattaattgatttataaatagattatagcttctataagaaaaatgtcaatataaatattgaaaaaatctaatttttttattattttttagtatattcataaactataaagtgaaaatcataaatttgtatacaattatacactattcaaataaaaaactgctattaagcagtttttaaattccatatagttttaaaataacattataagctttatcaataatatttttagataaacgaccttcaatcgagaataagcgtccatatgtagtttttcgaagttccttgtataatttaggcttggtatattttaaataactccacaaatcatctttatcttgaatactctcaggtgaaccatcatgagataaaagggcacaagttatcaaagtaatcattgatagatacttgatcatataatgacgttgcttacgagagcgcagtgtataaatatcataataatcaatatattcacgtgctgtatctaataatgcaggaataaaaatatcgttattaataacattttcaaatggattacggccaaaacagtataaaggcatgtcgatatagcaaaatgatctaatatatggaagaggagcgtaggcaaacatctccatataaaaagttgcatttagaggaaaattatcaatcacttctttaataatcttagtttttataattaatgccggtgttaataaatattgctgttttttgaaatgttttatttcatgccagccaaaaattttatcacttggcaaaagcgaacgatagcttactttgcgtggtctttttccataacaacaaaaataatcggttactaaaacatccagatttgcttgtactcgaataatatcttttaatgtttcaatgacccgtactaaagatgcctgatcaaaccagtcataactattcaagagtttaaaatataatccggtggtatactgataagcacatttaatatcatcgatattttcagtatttttaataactttaaaagtatcagggtattcattttgatattccattgctacttcataagtttcatcagttgaatttttatcaataataataacttctagttcatcttttaataataaacaggaacccaatgctttgtgcatatactcgattgcgttgtaacaaggaatacatatagttaataacttcataatagcctccatttatattcttagttatatcttagcatatttatggcataatatatagttgatattgcatttgggacgattttatggtattttatttaagtatacgttaaaggagaattgctatgtatttcgtaataaattgttttattagtgcagtatgtattatttctttaattttattcactgaagtctttcctaaatggactaaattattagttggtgccgtacaagttgttacaacttcttatgctattgctattctaattaaaaaaatcggtgaatggacttcggtatggtcaggagattataaatacattaatagtaatttcttatggatcctacctatcgttgctgtaattactattgcagttgcgtacatctgtaataaaaaatcaaaaaaagcagcaaaataaaaacatgaattcaaattcatgtttttattttatacctttttctttagcaattgcatctaatgttgctgccatccgagttaatgcttcgataacttgttgatcatcacgataaacacctaatacaatacgtagatgtcctgctccaccgggtccataattaattccatcattaaccgccactttagcttcactaataagacgcttacaaatcgcactactatcgcctaaagcgctaacatcaacccaggctaagaaaccagaggctggcaattccattgaaaccccaggtactgtatttaaaatattgtaagcttgatgacgacgaatatcgtaagcacggttgaattcatccataaattcaggatgcttaaaagcttcaattgcagcaatttgactaacagtattagttgccccaatcacacttaccgcacaaccatacatcacatccataattacatcacttgccataatatagccaactcgataaccgcttaatcccatccctttagaaattgaacaaacggtaactgtatgttcaaacataccatctaaagccatcggtgcaataaactcattttcaaatgtaaaatcttcaaaagcctgatcacaaacaagtactaaatcatgttttaaaaccacttccctaattgccataagactttcatgattatagactgttgtagtcggattattaggatgagttaaaacaatcatcttagtcttgttactaactagtgattctaatgcttggtgattaatttgataatcttcagcttcatttaattcaagaactaccggcgtagcctgcatcattgtaatattttgcatattattaggataacttggacaaggaatgattacttcatcacccttttccaagaaaggatacattgcaaagaataaagcactatcacttccaggcgtaataattacgtttctagccggatttaaatctaccccatacattttcttggctttttgacaaatcattgccctaagctccatatttcccgttggagcagtgtaatgcgctgctacaggagattttattgcttcaagtgttttttccataatatgctcaggaattgaaaagtcaggcataaaaggatcggcccatcccattaatgctactccattttcagctaatttagcaaaactatcaccaacatccgctttttctacctcgctgaatagcccgccttcaaaccctaaaaactcttttttcattctatttttcatcttagtacctacttaataaaataaatatttttacgtcccggatgtaaataaattaatccatctcgagtaaatgctactgtttcttcagtatagaaataataatcttggccaaaagctttgctctttgtatttaattcaagtgcatatgttgtatcatatgacattaacacatcacctttaacaggaattgctttttgattattccataaaccaatcgttgtccctggtccatgaccataaatattacatggatgagaatataatacagcttcaattccttcatctttaccttgtttcaaagaatctatcaaaacatcattaccacttttaccatcagccatgttttcagccacaatatcttgaaaacgatcattaaccttcattccatcaagcaattcctgtggaatactctcttcatcatctttagcaatataagccaatctttgagtatccgtacaaatattcaaatatttaattccaaaatcacaatgtaataaatcacctttttcaattacaccaaaatatcggggattatctaaaccaggtcgttgtaaatcaacagttggttcaaaccaataatctaatcctagatctttaacacgctgcatcatcaaccattgtaagtcctcacaagtagtaacccctgggataatactttttgaactaaaagcttcttcaatcacagaaaaagcaacctccataacttctggatgtaattctaattctaatggagtacgcaactccatcagcttaattgccaacatatcattacgtacgattcgttcagcatattctggagccatttttgctgtaatcatttcatataacccctgtgtcaatccatcactaaaagcaaaattatttgaaacattgactgcaattgtttgtggatcatattctttgcataaacgatttaaacaagccatttgatcttcattattaaaatcagtccaataacttgtataatatggcgctaattcctcacttggcatacagagagaaaaacgatgtatattatccccctctttaacaaaagcaaacaatgaaattcttcgtgcagttggataattagctggtgtaattgcatgaaataatggatcttcattatattctttagaagcactgatccacatatcaacatcatattctttcattactttaggtaaaataagttctaatcgttctttcaaacaagcatctttaatttgatattgttcttttactgatctaatctctttcatagtttcctcctagaaaaataaggtacacaaagtgtaccctattttatttcttatttttcaactttagcataagctaattgataatgtccttctggtgaatgagttacacctgttactttagaagacattaagtatggttcagcatatccaaataatggaattacataatgttgttcaccaactaaatagttttctgcagcatgtaaagcattcatacgttcagttttatcatcaattgcattagcagcagctactaattcttcgtatttagcatcatctactgtgttacctggagtagttgaaccaacatacattgataaataagccattggatcgatgaagtcagcagtcatggcatgacgacagatttcgaaatcacctttgtcacgagcatcaaagaatgcttcaccttcagttgcacttaaagtaagatcaatataagcttctttcatagatgcttgcattgcttgagcaacgtttttatgcatagtgttatcattgtaagtatatgttaattttaacatattactttcactataacctttagaagtcatgatagcttttgcttcatctaagttataagtagctaatttttctacagcatcttgttcttcacggaagtcaccagttgctccaggaataccttttggaattaatccatttaattcataagcattgtcaccatatcctaatgcttttaaaacattagcacggttaattgataatccgattgcattacggatatcagcatcttttaattcttctcttgtattttcatcaccagcattgattaatacgtagtagttacatacaaaaggatcgattttccaagattgtttctttaattcatccttgctattgatagtatcaatgttacaagaagtagcgaaatctaaatcacctttttcaaacgcactagtttgtgcatccatatctgacattactttaaaagaaatagaatttaaagtaacatttttagcatcataatattcatcatttttttctaataacacttcatctttagtgtttacagaagttactttgaatgctccattgtaaggaacatcagaattgttaccccaagaagattttgtaatatcttcagcattttctttcaaataatcttctctaactggatagaatacagtgttagttaataaagaagtaaagtaagcacatttagattttaacttaatttgaatagttgtatcatctaaagcagttgctccaaagtcttttaattcatccatagtagtataaggagtgtcagtttctttacctgttttcttatcctttaccatatgagaagtaccatcaatatattgccaaataaattgtgtgtagtaaccaccagtagttaccgcacgtttccaagcatatacgaagtcagaagcttttactttttctccatcgctccatttagtatccccagaaatcttaattgtgtaagtaagaccatcttcactgatttcaggcatatcagttgctaaattagtaattacattaccatcagtatcaagtgtatataaaccttgataaacttgcgctaaaatgttagcagttactgaatcatcaacgattgcaggatctaagtcagcagtgtcttttcctactgcaactcgtaaatcggcttcacttccgccaccacaacctgttaaacaagttagagccattaagaagctaagaccataagctaatagttttttcatgttttttcccctttcaactatttctcatataagaaacatgccacttgacgatttccaactgtttttaaagctggtttctcttgtgcacatctctcagttgcctttggacagcgtgtcctgaagacgcatccactaggcggatttatcggacttggaagctcaccttccaatacgatacgttttttgttgcgtgctaccttaggatccggaataggtaccgaagataacagcgcttgagtatatggatgaagtggctcatgataaatatcatcagcatccccaatttcaaccatatttcccaaatacattaccccaatacgatcagaaatatgtttaaccatacttaaatcgtgggcgataaataaatatgcaattcccatttcattttgaatcttttcaagtaaattgataacctgtgcttgaatcgaaacatccaaagctgaaatcggttcatcacatacaataaactttggatttaatgcaagggttctcgcaattccaattctttgtctttgtcctcctgagaactcatgaggataacgacgaatgtgatctggtttcaaaccaacgatctctaataattcacgaactcttttttcgcgttcttcttttgtatcataaaccccatgaatatccattggttcacgaataatttccccaacagtcattcgtggatttaaacttgcatatggatcttgaaaaatcatctgcatatcacgacggaactcttttaatttagctcctttaatttttgtaatatcttcaccttcaaaaatgacttgcccttctgttggatcataaattttaaccaaagcacgtccagtagtacttttaccacatccagattctccaactaagccaaaagtttcaccaggagcaatctcaaaatccactccatcaactgcttttacaacttgttttttagctaagaatccaccagatactgggaaatgaactttaagtccttttacttttaaaattggttcactcattgtctattcccctttccttttcaaatatggattatttaaccagcatgagctgcagtgagtacttgaaaaattacgatactcatccatgtgatcaacacaaatattcattgcgttttcacaacgatcaaggaatggacatccttctgaaatatttaataaatcaggtggtgatccagggatcggatgtaattcttttttctctaaatcttcaggattggcaatacatgaaagtaatccttttgtatatggatgttgtggattatagaaaatttcatcagtagttccagtttctacaattttaccaccatacataatagcaatacgatcacaaatactagcaactactcctaaatcatgagtaatcatgataatacttgaatcgatttcatcttttaaacttccaatcaaatctaatacttgcgcctggattgtaacatctaacgctgttgtaggttcatcagcaatgattacttttggatcacacgctaaagcgattgcaatgatgattctttgacgcatcccaccagagaattgatgaggatattgacgaattcgatcttctggtgaaggaattcctactttacgcattaaatcaatcgctttatcacgtgcttctttttttgaaatttttggattatgattaataatcggttcaattaattgagtctcaattcttaatgtcggatttaagaaagtcattggatcttggaagatcattgccatatcattaccacgaattcgatccattgtttcttcatattttttacgactatcaaaatgagtcggtgctatttcttcaccatcaattttaattgacccattagttacactaccatttccagctagtaatcccataattgagaacattgtttgtgatttacctgaaccagattcaccaacaacacctaacacttcgcccttatctacataaaatgatacatcacgaacagctttaactgttccattttcggtactaaattcagtagtaaggtcatttacttctaacatcttcattctataattcccctcctacttcttcttagggtcaagggcatcccctaaaccatcaccaataaagtttaaagctaacatagttaaacagattgctaaaattggccatacaacctgtaatggctgtgaactgatcatcgcccgtgcatcattagctaaagtcccccagctggcttgtggagctgataaaccaatacctaagaatcctaatgttgcttcatagaaaattgcacttggaactaacattgtaaatgaaacaataattggtcccatactatttataatcaagtgttttaataaaattctttttttgctggctcctaaaacaaaggctgctaatgagaattcttgttcttttaaagtcattacttgagcccgtacttgtcgagccatccccatccatgaggaaatacagatcccaattatgatcgactggaaatttgaacccaatacaactgtaatcataattaagtataacatatctgggatagaatataaggcatcaacgatacgcatcataatcatatcgacttttccgccagcatatccagcgatagccccataagtaaccccaacacataaagaaataattgcggctgagaatccaactgcaagtgagatccgcccaccgtacataattctaaccagtacatcacgaccaaagcggtcagtaccaaagatatgatccattgatggaccagcgaaagtattagccatattttgtccatcataagtgtatgatgaaaaaattggcacaaagatacatccaattgccattaccaataaaaagcataacccaatcaatgctaatttatttttcttgaaacgattccaagcatctgcaatatatgttttactttcgtaagcgattttttcgctattctttttcgaatcatctaacttctcaaacatttctggagtaagttcgatgttcattaccttattttcttccatcttgcttcctcctattttaatttgattcgtggatctactactgctgatagtaaatcagtaataatattaaatgaaattaccaagaatcctaagaatattgttaatcccataatcattgaataatcacgagtttgaatacttgaaaccatttctcgtccaattcctggtactgagaatagagtttcaataacgaaacttcctgttaacatgtaggcaaacgcaggacctgcatatgtaataactggaataaatgcattttttaacgcatgcttaataacgacctttttataaggtgttccttttgaccgcgctaagataatataatcttgacgcataacttcaagcatactacttctagttaaacgacataccatggcaattggataaaacgccaatgacaaggctggtaaaacataatgagccggtgaagtcagccccacaaatgggaacagcttcaatttaacccccagaacaatcattaaaagtaccccgatcaaaaatgatggtacagataccccgattgttgcaataaacatacaaagattgttaagccatttacgttttgataatgcagctgcagtacctagtgcaactccaatcactagtgctgaggcaaaagcaattgcacctagtctcgctgtaactgggaaactttgtgagattgttgtacctacatcacgtccaggacgaacaatactttcccctaaatcaccatgaatcaaatcattcatgtatagagtatattgctcaaatactggcttatctaaattgtactttttaatcgcaatttcgcgtgccgcttcatttttatatttttcaccactaattggcgaccctggtgttgccttcatcaaaaagaatgttgctgatgaaagtaagaacagtgttacgataccaatgagcacccgctttaaaacatacctaaacatttaatcacctattcctttactatatatctactaggataccttaatatgtatcaaatttcaaacatttttttacacgctaaccccatgagcccctagggattccgcccaaaaaccgcaaattgtatacgattatacacaatttgttggtattaaaatttttttataaataccatactttaattgatttctgcgataattataccaataatttattatcgagtcaataatttatttaattttgtattaaagcgcatacaatttaatttccagaataaatcccttttctcatacttttagcactatttgctgcctcaataatttcatttttataagtgtagtcatatccgtaatcatagaacttttcaactaaaccttcacgagcaatttgttcttgaagtaaatcaccatctacaaagacccatgctaataaacgcccatacttatctttactatcaccatctacatttaattccaattcgattttcgcagcattcgtcaattgtgtttttgtataatcgctcgcttctttaccatacggctctatctctttagttgattcaggtgtatcaatatataaaaaacgaacttttgtactctcaccatctacattgaaccatgctgtgtcaccatcaacacatctatctaaagttacttcaaatcgttcgcctgtgggaattgatttgttctgctgataaaaattgtaaccaattaccgccaagataactatgattccaagccatgatcttaataatttcttttgttgtgtttttgttagtttaatcttcttagccattaattccaaccgcctttttcgctaatacatcagctctttcattataaaaatcaccactatgggctaatactttgacaaatgcaatttttaaatcttgacgatactcttttactttacgctgatattcttgtgttcctggtttgtttgctttccacataccatttgcccatttttcaattccctcgtaatcaaaataaatacaaatttgtttataaccattgtttttagcaaattccattgcacaaatactgcctaaaatttcacccgcaacattacgcatcgaagcataattttcatcagcacctttaccatacatttctttgattactttttgttcctcaataatcacacatccaaaaccatattcatgtgtcttaatattgtagctgccatcaacataagcaattaaacccccatcaaattctatcttttcttctttaataaatacttttgcatcctctaatgaagtaaatgatttatatattgctcctttaaatttctcaacttgtttcttacattcatcccaagatgaataaattcctggtttgcgaccattttttactgcataatatttagccataacttctcctttaataattgataaaatgattttaaactagaaattctatttagtaaagaaacttaaagggtactaaagtaagaaaaattaatttccttagccctcaacagttgtctatttatcaataatgagtataattaatgtattaggttaaaggagaaataatatggatattgaagaaagatttttaaaatatgtaagcattgatacacaatcagatgaatactcagatactaccccttcaacgctgaaacaactagatttaggaaaagaattagttaaagaaatgttggaattaggaatcacagatgcacatttggatgaatacggtattgtttatggaacaattaaagggaatggtggtaccggggatatcatcggctttattgctcatatggatacttctccagatgctagcggaactaatattaaacctcaaaaaatcaataattatgatggttctatcatcgaaatcaataaagaattaggactttctttagaccctgaagaatttgttagtctaaagaaaatggttggtcatgatttaatcactactgacggtactactttattaggagctgatgataaagctggtgttgctatcattatggatttagcaaattatttgtatgaacatcctgaaatcaaacataatgatattaaaattgcttttactcctgatgaagaagtcgggcgtggagctgataatttcgatgttaataaatttggagccaaatatgcctatactttagatggtggggatattgaagaatataattatgaaaactttaatgcatatagtgctcaagttgaaataaccggaaaatcaatccacccgggaaatgccaaagataaaatggttagtgcaatcaatgttgcaattgaatttgaaaacatgctgccagctcagcaaaaagcatattttactgatggttatgatggtttcaatcatcttcaccatttagaaggtggttgtgaaaaagctactttagaatatatcattagaaatcacgatcttacattagccaaaaaacaaatcaatgattttaaacgtattaaaaaatatttagatgaaaaatatggatatgaattgatcaaactagatattaaagaatcatatttaaatatggcagaagttatcaaagaaaattattatataattgaaagattagaaaaagcaatgaatagtgttggaatccaaggttttgctagtcctatccgtggtggtaccgatggtgctcgcttaacatttatggggcttccttgcccaaacatcggcaccggcggtgataatttccatggtccatttgaatttgtttcactcacgatgatgaaacaatcagttgaaattttaaaagagctgattaaagagtagttttatgaaacgctgtttattcattattaatccgtcttcgggacaacggactattcaaaacactttagataaattaattgggcagcttactttgcgtcaattaatttatcatattgatgttttctacaccttaaaaaaagatgatgcttattttaaagcactaaatgctgacgaacaagactatgatttcattacagtagttggcggtgatggaacgatcaatgaagtagttagcgggatggttgccagcgataaaaaaattccactatgtatactggcagcgggaactgtcaatgacttcgcaaattatttgaacctacctagcaatatcgaaggagtttgtaatttaatcaataattttaagactgtctgttgcgatgtaggtaaaatcaacgaacgctattttatgaatgtggctgccgggggaatgttcagtgatgtatcattcaccgttagcaaagctgataaaaaaagattaggtcccttagcttactatctaaacggtattgctaatcttcctagtcaattaaatactaatattaatttaaaaattgttttagatgatgctaatattttagaaacagaagcaaaaatgtttatggttacaaatacaaatcgtgttggcggatttgaaaatattatcccttatgcagatattcaagatggaatgcttgatttaatcgtaataaaaaaatgttctgttactgatttagttgctctatcaaaagattatttgttgaaaaaacatgctaatagcccatttatttcttatgttcaagcaaaaaaaattgagatttacagccaacaaaaagttgtaattgatattgatggtgaagaggggtcaccattgccagtgacaattgaagcaataagccaagctatcaatattttagtaccataggagtttgttaaacagactccttttttattgtttgattatttaatttatattataatctatctgtacatcaaggaggaaattacatgcacccaaaatatcatttaacagcccctaaacattggatcaatgatcctatcgggtttatttattaccaaaataattatcatttattttatcagcattttccttatgaaaataagtggggaacaatgcactggggtcatgctactagtaaagacctagtaaactgggttgaccagggaattgcattataccctagtaaagactttgatgcaaatggttgtttttctggttcagcattagaagttgataaaaaaatgtatctatattatacgtctgttgtttatcaaaaagtcaatcccgaaaatattcataaaactgccccaggttatgatttttattctagccaaagtatgattataagcgatgatggatttaacttcgataatcttaatcaaaaacaattgatcattccagtatttaaagatggcgaagtcggtcatcctgttcatacacgtgatccaaaagtatggaaattccaagatacttactatatggttttagcaagtaagtatttagatgataacaatgattataatggtcaattattattttatacttctaaaaatgcaactgaatggcattatgctaataattatcgcggcattaaatgcggtgatatgtgggaatgcccagatatttttacagttgcccatcaggatatattgatcatgtctccagaacggactaatgatagcggctatccatctcacgcacgtattacaacagctaattttgatcatcaaaactgtcaattagagattactggtgaactaaattatcttgactatggtttagatatttatgctccccaaacaacgattgacgaagccggacgaagaatttatgtaggctggatgcgtatgcctgttgccgatgaagctaactggattggattaattacttatccacgtgtaatcacatatcaaaatgatgctatatttacgaatattcatccatctgtcgatagtctctttaaaaagcctgcaactgagtttaaagctacgcaggcatgcaagatcgtgactaatttaaaaacaggtgatttcataaatattggaggttatcttatcaagtatgacgattgtctttgtatcgatcgttctaatgtgtttaaatctgatgcggcattaaaagagctacgttcaccaaaaatcgatcactgtaatttaaacatctactatgaccaggatattattgaaatttatattaataatggtcaatatgttttatcaaatatcgtctatgaaatggcagatacgattaagagtaatactggttttgaaatctttactgactagaacttgttttaaacaggttcttttagtttaaaaataacttattatggcaaatattgctgatttaaaaccgttttatacttctgtgaccccaatttattaaattttcagaaaaactcctcaaattcaacaaaatcagtcatttaaggtaggtatattattataatcatttcaatattttatgaagacaactttgattaaaaaattattctttttaccaaaataataaaagcgaattctcttgagaactcgcttttgcctttatctgctgggaattactattgcggcaataatataagcaataaagccactgcctcccatagcagagaaaataatccaacctaatcttaccaatgaaggatcaagatcaaagtattctgcaattccaccacatactccacaaaccatccgatcttgtcgtgatcgataaattcttttcatttcttacacctccatcttaattctaatacttccaacattacaatcagcttctattttacgttgaccgccactatgactatattcatcactcagtccgtcacttcgataacttccaatactaatatcaccaacatcactatcgacttcataactgtaatctgattcactacctaccattgttgcatcaatatctccagcatcgcagttaaattcacttcgataactattcaacaagttaatccgtgcatccccggcatcaacgtctactttagtatatgatgcaataatattttcggccttaaaacttccagcatccacatcaatttcaacatcattagccttcaaattaggaacaatcaattctccagcatctacttctaattcaactttattaaattcatagctattcggtatataaattttaattctagttgttatatcggtaacatttataagatgccaaaatctaaaactatcctttacaatcaaagtgttttgttcttgatataatttaatttttttgctcacattttttgcttcaactttaattgtactaccttcatattcaattaattcaacagttccagcttctgcttgaatttccaaatttttaatgtctgtaaattcttttgttacatccatcgttttagtaataggtagactgattgtaaaatcacccttatcataaagagtttccagttctgaaaaaccaccaatcatcgtaccgctgatgaacaatacaattgcaagcaacaacgctcctaatgccacataccctatttttttcatcgccgatcacctaccctattaaatatattttgacaaaaatcaacgattcctctaataacagcagggattattttaatcaaacctttagctaaccagaaaaagacgaatgctaaagcaattaaagcacatcctgccgccatggtaatcaatcctgcgcctggatacgctgcaataatcataaatgctttgacaaagcagactatcgcaccaatcaaacaagcggctccaccacacaaaataccaactccaaggccaaatacagctccaaaaaaacctaatcctaaaccaagaatcccaccacctactggtaaagctagaaaaacagccccaataatgataaatattaataagattcgatttcggtcggaatttcctctaaaattattcttgtgacgtttattattttgataatcattattatcatcagcagctgtctcctcttcactaataattttagcatcaataatttcacgagattgtttataatttgaattatccatccctttttcactatactcaatatcctgatcaaactgattatctaaaccagctttaatgatcgctgcaacccgttcaggagagcctaaatcatttataacctgctgttcattttctggaccagcttcatcaaaataatcttcataatattgcatagcttcttctcgttcagcatcttcaatatcttgaagtaaaaatgctagttcttcaataaactttttacgattcataattatttccccccttcaataattttattgatcttacgcacatactcatgccattcccctttatacatctcaagttgagcttgtccttgtgacgttattttataataacgtcgatttctcccaccatactcttgatcatatgtttctaaacaattatcctttaataatcttcttaaaacaggatacaaggtcgattctgaaacatcaagagcaattctaacatcttgtgtaattttgtaaccataagttccctcggcctccttggaaactactgaaagaacaattgcatctagcaatgcagctcctgtattaaatatcataagcccagctcctttcatatttatctttcaataatattatattctatatagtattatctgtcaactaataatatataataattatatattataaaaaaagaaacatcatttgatgtttctcattagttacaggtatgtactccttccttaaatttctttaaagtttttgttatttctaacatacatatccaatatatgtataaataatttttcctctatcagtaatttcattgttctaaatgtctcatagctcaaataaaacgccataaccaacacgattcgcctccaaaacatcgcattgattctcaattgcccaaacttttaataacgctatccaatattcatcacatcccaagcgattactataattaagctgcttgtatatgaagccatttgaaaattctggagaattttagattataacaaataaaagcactaatatcttatccattctcaaaatttaatttcactgcccatctgataatattccgcttatttaaaataagatgtatttcatcgtaactgaataattccttttcatgatttacaatcatcaaattttaaaattatgacattgcaattttcatcaacgttttcccataggctattaacataaataaaattttatcactttgttaattattgttttttttaagatatttttcacatattcatttttaataatattttcaaggaggtaataatgaagaaggttaaaaatatattgattggactattagtatttagcattattgcgttatgctttatctttaacggtcccttagttaccgaggcctctagtgatgatgaaaatagtcgtccctatacacaattaaaaaataccactagtgatccggaaactatttacagtgataaatatcaaaaaaatatttatcagcagattaaaaagattaaacaaataaataattacacttttaacaatcccttgttaattgaaaatccttatggaacaaacaccacaggaatctatatgtattttacaactgattatcaatgcgttgcgacatataccatcagttgcgaaggatacgaagacttcaccagaacacttaatactaatagtttaagcggcttttctaaagaacatgaatatttgctaatcggatctattcccgatgctaaaaacactattactgttacattaacggataccaatggcaaacaagttgattctattacgtggagctatcaagcacctaaattatcaggcggtgatcaatatctcagcgttgcaactgaaagttatgatactacatcagcgctaagcaacggtttatacaccgttttaggtaatgatgtaaccgaagaaaatgatgaacagacctatatgcgattatatgataacgatggcgtgattagaagtgaaattcctatcatttcataccgcagtcatcgaattttattcgaagataatactatgtatttaagtgtttcaagcacaaagatcgtaggagttgatcaaactggttatgtttcgacaatttattctactggtgattacaaattgcatcatgactatattttcgacagtcaaaataacttaattgttttagccagtaaaaagaatgcggtaactagtgaagataaaatcattatgattgatcataatactaaagctatcacagaacttgttgatttaattgaactctttccagattactataaaactaccaccaagccagattctgcagatgatttagattggatgcatatcaactcacttgaactagttggaaaagatagtttgattattagttcacgagaaacttcaacaattatgaagttagataatatttatagtaatccaacagttgactatatgatcggttctaataatttctggcaagaaagtggttacgatgatttacttttgactaagacaagtgacttttcattgcaggcaggacagcactgtgttacctatgttgaagatgccactcttgccagcggacaatattatttatatctatataataataatctagcagtcagtacaactcgcagcgattataattggaaagaagataataattatcaaaatgtttcttacgatactaaaaacggtatttcttattattataaatatttaattgatgaaaataaccgtactgtttctttggttaatacaatccccgttgattactctggttatgtaagcagtgtccaagaacttgataacaatattattattgatagcggaatggcaatgtcatggggcgaatatgatcaatttggtactttgatcaaaaaattcacaacaaccgggggcaaattcgtttatcgtgtctttaaatatgattataatgactattggtttcaataacccaatagtcattttttaatctatgtatagatatttatcatatttaatatactaattaatttaaataaaaagagcctaagctctttttatttatttttctaatgcctgttttgctaatgctagagcaccacacacaccagcattatcacctaaagcaggtgatacaatataatcatcaatcttatccgttaaaatttcatctttttgaatatatccatttaagaattctcttaaatatttatgaattaatgggaacatttgtttttgttttgagaccccaccacctaagatgattttctttggtgaaataactaaaacataagttgctagagcctgaccgatatagtaagcttctaaatcccaagcaggatggtcagccggtaattcaaaaccttttttaccccaacgtgcttcaattgccggtcctgctgctaaaccttcaaaacacgtaccgtggaatgggcatttacctgcataagtatcgtcttcacgaacaatcatattcatgtgtcccatttctggatgtaataacccatgaactaaatttccttcaacaatagcaccacatccaattcctgtaccaattgtcatatacaaagcactgtctaaacctttggctgcaccaaaataagcttcacctaaagcagcaccattaacatcagtatcgaatcccataggaatatcataacgttcctttaaagcacccatgatattaaagttaccccatcctggttttggtgttgttgtaatatatccataagttggactgtttaaatctggatcgattggtccaaaacatccgactccaagtgcctcaatatcttttccatcaaaaaatttaaaaatattcgccattgtttcttctggagtttcagttgggaaagaatctctttctattacatttccaaattcatcaccaatacaaactacgaatttagttcctccagcttcaattgcacctaatttcatctattcttcctcctcatttttacatttccattatagcttaatttactatacaaatgaatagtttaagtgcaaaaacagaaacttttgacaagatgtttcataagttttcgtaaaatcatcaaattcatgaaactacgtttcatctaaaaaaatatagatagtattaaactatctatatttatccgtatgtaataatttattagcgttatcaatacgctcttgatttggtgggttaattccgtctaattgataaggaatccctagttcttcccatttaaatactcctagtgtatgataaggtaaaacttccactttcttaacattattcaaagtactaataaatttatctaattctgttaaatattcatctttatcactgatacccggtactaaaacatgacgaatccaaacaggtttatttatcgtacttaaatattttgccatatctaaaatattatcattaccttttcctgttaactcttgatgctgtgtactatcaatatgtttaaggtctactaataataaatctgtatatttcattaattcattaaatttagaaaaaaacggttcttctctagtaaaattaccaccactagtatcaatacaagtattgattccttcttttttcgctaatttaaataattcaattaaaaaatcaatttgtaataatggttcaccaccactaactgtaattccaccatcatttccccaatagctcttgtatttaagtgctttagcaattgcttcttgaggtgtcatttccattgtcgacttagcattagcccaagtatctggattatgacagaatttacagcgtaacgggcatccatgtagaaagattatatagcgtattcccggaccatcaactgaaccgaaactttcaatagaatgtacaaaacccttgattgctgtttccatgttaatctcctttttcattaaaacagcctcttttaattaagaggctgttgttatgcttatttttcaataactattacatagatttatggcaagttcttgaaataacatccatttgttgttcacgagttaaatcaatgaatttaactgcatatccagatacacggattgtgaagtttgcatattcttctttttctggatgttccatagcatcaattaatttttcagttccaaatacgtttacatttaagtgatgagcaccttgtgcaaagtatccatccattacttgaactaaattagttttacgttcttcttcatcatgacctaaagtatcagggctgattgtttgagtattagaaataccatctaatgcccattcgtatggtaatttagcaacagaatttaatgaagctaataaaccagattgttctgcaccgtaagaagggttagcacctggtgataatggttcaccagctttacgtccatcaggtaatgaaccagtagctttaccataaacaacattagaagtaattgttaagatagaagtagttggttctgaatcacggtaagtgtgatgttttttaagtttatttaagaattcttttaataaccatactgcaatatcatcagcacgatcatcatcgttaccataacgagggaagtctccttcaatttcgtaatcaattgcaataccatcttcatcacgaactgttttaactttcgcatatttaattgcacttaatgaatctactacatgagagaatccagcaataccagttgcaaatgtacgtcttacatctgtatcaattaaagccatttcagctgcttcataataatatttatcatgcatatattggattaagttaagtgtatttacataaatatcagctaaccattccatcatttggtcatatctttccattacttcttcgtaatctaaatattcagaagtgattggacgatattttggagctacttgagtttttgttttttcatcgataccaccattgatagcgtataataaacatttagctaagttagcacgagctccgaagaattgcatttctttaccagtttgagttgcagatacacaacagcaaattgaataatcatcaccccatacaggacgcattacatcatcattttcatattgtactgagctagtatcaattgaaatcttagctgcatattttttgaaattttctggtaatgcagcagtatataatactgttaagtttggttctggtgaaggccccatgttttctaatgtgtgtaagaaacggaaatcatttttagtaaccatagaacgtccgtcagttccaagtcctgcaacttctagtgtagcccatactgggtcaccagagaataattggttgtaagaaggaatacgagcgaatttaaccattctacatttcattactaaatgatcaattaattcttgagcttcagcttctgtgataattccagcttctaaatctctttcaagatagatgtctaagaatgttgatacacgtccaactgacatagcagcaccattttgagttttgatagcagctaaatatccgaaatataaccattgaactgcttctttagcatttttagctggttcagaaatatcgaaaccataagcttcagccattttcttcataccatttaatgctttaatttgttcagctaattcttcacgttgacggatagtatcatctctcattgatccacttccgcaatgtgctaaatcattttgtttttcttcaattaagaaatcaataccatataaagcaacacgacgataatcaccaacgatacgtccacgtccataagtatctggtaaacctgtgatgattttattacgacgagctaatctgatttctggtgtatatacatcgaaaaccccttggttatgagttttatgatattctgtaaagattcttcctaattcaggatctggtgtatatccataagtttcacaagcttgttgtgccatcttgataccaccataaggcataaatgctctttttaaaggtttatcagtttgtaaccctacaactgcttctaaatctttaagttcttcgtcaatatatccagcaccataagcagttaatccagaaaccacatgagtttccatatctaatactccacctttagcgcgttcttctttttgaagttcttgtaatttaccccataatttatctgtagcttcagtaggtccagccaagaatgattcatcaccatcatatggcttgtagttattttggatgaagtcacgtacgttcacttcctctttccaaagtctacctttaaagccattccattgatctttttctaacatgtttctttcttcctccttgaaatttaataactgttagttaagtttcttacttaagttttaaataataatctgatggatttgcaagggatgtcatcaagactaatattctactactatcgtaatgcacttacataataagaataacacacactatattttggaaaataactttattttcctttgttatccacgactgcattatattataaattgtttttataattcaagtcatttgcaccaaaaaaacaaattattttcaacaaattttaatcattttttaagatataatgaaacagttgttttgttagcgcttacaaatactttttttaacttttaaagatttttattaataaatttaaaataaacgaatatattatattaccacgattttattatctatttaataaaataaaaatatttttacattaaaaattaaatctattaaatagtagatttttttttcaatttattatatagtaatatctagttgttaggagggtacaaaatggatttaacattcaacaccaatactgattttgatcaaacaaaagtactaattactaatatcattaaaaatactgctgatgactatgatttatttctttcagaaaattcaatcaataatctctcagtacatttaaccattgcaattatccggatcaaatcaaataattatattcccatgagtaacagtcaaatcgcttcatataaacaagatcatagttatccatatgcaaaaatgttatgcgaccgtttagcacgtgaatttgaaattgattttcctgaagctgagatttcattggtttccatgtatctatcaaaaaatcaaaaattagatttagaaataaattctggttttgatttacttgacgatcaagtttttaagattttaagagaaacaatgtatacaatttatcaagactatcataaagactttagaaatgatgataaattattcgttgctatcggtttacatttagaaccagctttagaacgtcttgcaaatggtcaacttgttgaaaatcctttaaaagaaaaaataatcgaacgtcatcaagaggaatttaattatagtaagattttaaatgatgttgttagacatgatttaaatctatcattcgatgatgatgaattagcttttatcgcattacattttgttgttgctaataatcgcatcgatgaataaaataaatatctaaataaaaatatcttcatttcgttgtgcttagtcagttttctaactaaacagtaataaatgaagatattttttatttatttaaaataaccaactcacttattcgtgttatgaattattatttttaaccaatttacatcccgcactagttccaattcttgtagctcctgcagctacaactttttccatgtcttcaattgtccgcactccaccagatgcctttacttctaaatcatctccaacagtttgtttcatcaaagaaacagcttcaggtgtagcccctcctgttgaaaaaccagtcgatgttttaacaaatgttgcttgagcttccttagctaatttacatactgtaacaatttcttcatcggtaagaagacaggtttcaataatcacttttacacatttacccgcagcagcatcaacaactgccttaatgtcattaaagactagatcggtattcccatcttttagtgctccaatgttaataaccatatcaatttcatcagcaccattagcaatagcatcctttgtttcaaacgctttaacggcacttgtattagctcctaaaggaaatccaatcacagtacatactttaacatcactatcagctagagcttgagcgcaataagctacccaggttggattaacacatactgaagcaaagttatactcttttgcttcatcaataattttagcaaccattgctttagttgcatcagcttttaatacagtgtggtcaatcattttattataattcatcttcatcttctcctttataatatattctttcaagtgcctctttaacaatttggctatcaccaggataatctacttgtcctacatcgagtgaaataaacttttcatgtcccttaccaagaatcaaaatgatgtcatctttacaagctatctcgattgcctgttcaattgcaatttgacgtgactcgataattacactattaatatcgacaatttctttttgaatcgttttacaaatttcataaacatcttcaccacgatcatccaattgtgtcaaaataacatgatctaagtatcgattcgctaattgcccaagttccttacgtaatttgtaattacgcttcccaggagcccctaaaaccgcaataattcgcccatgcccttgtcgaactccatcaacatattcaaaaatagcttcataattactaatgtgttgacaataatcaataataactgcaaactgttgttctgtttgaatcagttccattcgcccttcgatcggttttacattttcaactgcatcaatgaccatcttatcatcacatcccatagcaatcaacacaccggttaaagccaagacattataaatattgaacattgcgattactggggaattaacatgaaaagtatttcctttaaatgaaatatcaaactcactatgatctaaatgtaattgaatatttttagccataatatcactttcaatttcaattccgtaagtcaaaatgcgtccttgggtattattttttaaagtcataaaatttaaatcatcactatttaaaatcgcccatcccgtcggtttaatcatttcaaataatttttgtttagctaaaacatattgttcctttgttccatggaaatctaaatgttcagccccaatattagtcattacagcaatattaaaattaatcccgtcaacacgtcctaaagccaaaccatgacttgatgcctccattgcaacaactttgaccccagctctattcatttcaaacaattttcgttgcaaatacagagcttctggagtggtataaggacattcctctttacggccattatattctaatgaaatcgttcctatatatccactactacaatattttgccatagcatctttaatcattgaagcaactaccgtcttaccactgctgccagtaactccgataattttcattttattacttggacaatcataaaaaagatttgaaacacgattaagttctactaaagtattctcaacccgaaaataaataatcttatcatggtaataattaagatctttggaatgaacgattacttttgcaccctgaaaaacagcatcttcaacataacgatgtccatcaacacttaaaccttcaatgcaaaagaaaatcgaataaggttttacatatcttgaatcactatgaattgaatagattttcatatcgttgtcagtatcaaacaattcatttaagcgtttcattaaacaacccttccttccaaaatttcatcatatttatcaattttgatcgttacgatctcaccaattaaattatcagctgttttaactttaacttttaaataatcaccagcatgaccaattaaatattctccatctcttttttcaaataaaacttttaaagtttttccaatctgttttaaagcaaactcatgatttagctctttcgataactgcaataaacgattagctcgttcatgcttaatttgatcatttacctgatctttcattttagctgctggcgtattttttcgtggtgaatatggaaaaacatgtaattcactataattaacttgtttaataaagttatatgtttcttcaaactcctcgtccgtttctccaggaaaaccaactattacatctgtcgtaaaagcaatatttggtaaataactgcgaatcttattaattttttctaaatattcagctgttgtatatttacgattcatccgcttcaaagtagcatcacttccagcttgtaaaggaacatgtaaatgatctacgataatctcatttgagccgattaaatcaataatttcatcactaatttgacttgtttcaatcgatgagattcttaatcgctttaagcctttgatcttcactaaatctactagcagttcataaaaactatagtcatctagatcctcaccataaccagctgtatgaattccagttaagacaatttcaacatatccattgtcaactagcctttgggcttggtttaacacactttctttttgtcttgaacgcactcttcctctagcataaggaataatacaataagtacaaaaattattacatccatcttgaatttttaaaaatgcccgtgtatttttaaatcgatcaatatttagatcttcaaacttccttagattcattacattatcaactttaatgaccatttctccagtttccaaatgctcatcaacatatttgactatatcactacggtattgagttccaagaacaacaccaacaccttcgattttttcaatttcctccggggctgtctgactataacacccaactacacaaatagtcgctttagggttcttacgaattgccttgcgaatcatttgacgtgatttactatcacccgtatttgtaactgtacaagtattgataacataaacatcagcaacttgtttaaagtcaacttcttgatatcctgcttcattaaaaatcttcaacattgcgttggattcatatgtatttactttacatcctaatgtatgaaatgctactgtcttcatttactcaccttttttaatttctttattaattttttgtaggtcttatcaccaacaaatttattctcatataaaaactctaatatttcttcatcatcctgactattagctaatttaaccattgcttccttaatcaaattaagattagggtattcttttgtatatcgatcaattaaattaatttcatttgcaatacgataattttgtccattaaattgatataccgttttaaaatcatcatgataaaaataataactttcatcatcttgaccaaccagctgcaacgatgaaaattgtgaattgtatggttgtatcccatataattcaataactttatctattgttttagcataactatttaaataaacttgatgttgttttagtgttactaattgataatcattagcataatatctgtttataaacggttctaaataaggaatataaattatttctccactttgatgatcttgaaaacttgggaaattattaattatcttttcttcatcatgattaaacatttttcttttttcttcataattcacatattcaaaaatatcataattagctgccataaatttattataacactcatcaatcgctatttttgtcctaattccatttaaaataacttcatatacaaataaatcttccggtgtctttagtttataattaaagccttctcctgccagctctttattaccaccagtcacaaaattatataatcctgtcttatttaattttatttcataacgatatttatttaataaatccaatatactcattatccaatctccctagcataaccaattacacttaaaaaatataatggagctgtttcacttctcaaaattctttttcctagtgaacaagctttaattcctaatttattcatcatctcaatttcatcaagttcaaagccgccttcacttccaactacaatagtaattttatcacctgaagataattggtctagtatttgttttagcaccatatgttcaccttgtttagcaagttcttcaaaagctactagattatgatcacctaaatattgatcaagctgttctagtttgattacattagtaatttctggaataaaattacgccatgactgttctgcagcctcttttaatatttttcgataacgagtgatttttttagcaaacttttgctcatccatctttactacacaacgctttgtttgaattggaacaatacgcttgacaccaagttctgtagctttttgtaatactaattcaaatttatcccctttgggtagagcataaactaaagttatctcgacatctaattcattattttcttcaagccgcttatcaattttaactaaacctatctcaatatcttcaattacgccataatatacttgtccagcattatctacacagataatttcatcaccatttatatttcgcattacctttttaacatgatgcaaatcatcatccggtaaaattagttgttgtttacttgttaaatcttcatttataaaatatcgttgcataatagacctccgctaacattctaacacgaattatcgacagagaaaagcaataaacgacatcactttttttactttttcttctatttttatcagtattaatttagtaaattaaaaagttgatttccataagcaaaatgtagtgaactgaataagttggaccacaacttattcagttcactacaaatatcaccttttttaaattattattgtcccctattacaatttcacaacttgttaaaactcgatagtcactcgctacctattcacgtaactctggaattatttgtggtttggcatttttaccagttatttctgtttctttagcagaaatttttatcattgcattcttttccgtcataaatgatgacccatctgtttcattcgttactttagataataatttaactgtctgagtgtgaagttaccctttgccatctaatgatatcatagctctcttatcactccctcccaataaaaaaaccaaatataattttgcctaaaaacacaaaaatatatctggtcttacctcctcaaagcaacaatccttctatggtataaatataacacggaaatgaatattatcaatatttttagtgaaaccattaataaaaatataatccaatttcagtaaaatttcaaattaattttccaaatttttctacgattttatccaaaaaattatttccataatcataaaacttttgatgtttgtaagttcttttagaaaaagacttaccatactcatgatttaaacaataaccaaaatatattacactagaaattaaataaattgaaatcagcatgattactaagctggcaagcggcccatacaaagcattatatcgtgtataatgattgacaatatagaaaaagaatactccaattaaaacaatgcatgcactagtaaaagcagccccaatcaagccatatgataatggttttttttcaaatgataaatatcgataaaaacagtaaaatacaataaataaaccagccaacataacaattgtgctgttaattggtactaaataattaaataatgttaatcctactaaaccaattactaacaaaacaaaaactacgatagctttaattcgcactaaaatcgcataagtatcaaaaccttcatcagtcattgaaatcaacataaaagaataaaaagcattactcgctaaataaatagaaaatcccattgaaataatcaatgatacaaatgttgtatattcttgtgacattacatactcaacaaaaggtgctaaaattgtttcaggaacataatcatatagtaaattaattaaattaggcgcacttaaaatatccgtttgaaaaacctttaaaaaaataatcagtgccggcaataaagctaacaaaacacaaaaacttaacgaataacgaaacaagtttccctggggcgaaataaatttcattacaactctttgaaatctttccataatccaccatccctctttattgttaactatatcacaaaaatgcatacaaaaaaatagttaaaggtgttcaaagaacacctttaacttattgaatcgctaatttaaaatcatcatcaaagtcaactaatacatgacttccatttttaatatcacctttaatcatttcacgagcaaccaatgtttcgattcgtgactgaataaaacgttttagtggtcgtgcaccaaatgttacatcataaccttgttcactaattacagctttagctctatcacttactgtaatagtgatctttttatcacttaaacgatcagatagttgtttaataaatttatcaataattttattaacaaccgcttgatctaatgagttaaaataaacaatctcatcaatacgatttaagaattctggtttgaaatgtgctttcaattcattatcaaccgctgctcttgtatcactattattaccttctaataagtaatttgaaccgatatttgaagtcataatgataatcgtatttttaaagctgactagatttcctttagagtcagtaattcgaccatcatctaacacttgcaacaagatattaaatacttcgggatgtgctttttcaatttcatccaataaaacaatactataaggatgacgacgcacagcttctgttaattgtccaccttcttcatatccaacatatcctggtggcgctccaactaaacgagaaacactgaatttttccatgtattctgacatatcaattctaactatatttcgctctgtatcaaataattgctcagctaatgacttagctacttctgttttaccaactccagttggacctaagaataggaaacttccaattggacgattttcatcattgattcctgctcttgatcttaaaattgcatcactaactttttcaattgcttcatcttgaccgattacccgtacctttaacgcagcatctaactttaataatttttcacgttcagattccattaatttattcattggaattcctgtccagcgagcaattacttcgctaactgtatctacagtgaccttttcttgtaataagtcatcttcttttttagaagcttcaaattctttaatttctttttcgatttgtggtaatgtttgatatttgattcttgatgcttcttccaaattaccctctgtctgatatttatccgttaaagcttctaatcttactttttggtcttttaattctttaatatgatccaatgatttcttttcttcttgccatttgtcagttaaaccttttacttgttcgtctaaagaagcaatccgacttttaatctcatttaaacgtttttcattatcttcatttttgtcttctttttcaattgaaattcgttccatttctaatcgatttttctcacgtgttataacatctaactcttctggtaatgaatctatttccatacgaatagaagcacaagcttcatcgattagatcaattgctttatcaggtaagaaacggtcagttatatatcgttgtgacatattaacagcaccaataattgcactatcagtaatttgtactccatgatgtgattcaaatgaatctttcaaaccacgaagaatggcaattgtatcatcttgatctggttcatcaacttgaactttttggaaacgtctttcaagggcagcatctttttcaatatacatccgatattcatctaatgttgttgctccaatacaatgcaactcaccacgagccaacattggctttaataagtttgcagcatccattgccccatcagttttaccagcaccaactaattggtggatttcatcgataaataagataatatctccttcagccttcttaatttcatttaaaacggctttcaatctttcttcaaattcaccacgatatttagctcctgcaactagtgctcctagatctaattcatatagtgttttattttgcagagaaactggcacgtcatttttaaagatacgccaagctaatccttcaactattgctgttttacccacaccaggttcaccaattaaaattgggttattttttgtttttcgtgataagatctgaatcacacgacgaatttcttcatctcgcccaataactggatcaagttttccatcggcaacatcttttgttaaatcacgtccatatttttccaatacttcgtattggttttcaggattttgattatcgaccatatttccacctcgcatttcatcaataattttctttacatttttcttatttaaattataaccatttaatatttcttttaaccagctactatttaattcaaataatgccataattaaatgttctacacttagatattcatctttaaaattatgcatttgcttatccgctaaactaagcagttgattcaaatcatatgagattcgaatactatttatatccacattacttacaatcggcttaccttgcaaccttacgttcaatttattttgtagatcggcaatattgacatttgccttacttaagactcgatataatatacctgcattgtcttccagcaaagctaatagaaaatgctctacatcaactacttgatgacccatttcactagccattgttattgctttttgaattgcttcttgcatcttggcagtccatttttcaatattcatgtctatcactcctttagcactctatatccctaagtgctaattatattatacatctctttttagcactgtcaaggttaaagtgctaaaaaattaaaatatttatttttaaatctacttctgtctagatgtaaaaaactagggtttgtcaccctagtttaatctaatatccaattattatttaccaaaatatctgtttaacaatccttcaaacgcttttccatgacgtgcttcatcacgtgccatttcatgcactgtatcatgaattgcatctaagtttaatgcttagccatatatatcctgtttcctgcactcatcattctcacctcaactgcctttaatttaattattaacacatcattagtaattaaactgattccaaaacgattataaaatttaaaagtgcgtaattcaacgaactacacacttaaacattaattatttacttttaactgacaaattaaggttttcatatttaattaatacaactgctatacggagtatatcctgcatctatagtcttctttgtcttctttcactattaaatatacaatataccaaaagaatcacattatcatttataggatatacatctaacccattccatgtactatatgatttatgcacttttctatttatcaatattaataaatctctctacggtcccctcaaattcattatccatataaaccacaatgtcactatcagttcctgataaagtatctgaatagtaatggaaagtcaatctagctaataaaatttttaaaaatagataattttagtattagtatctatattattgtcactataaaaattaacttcttctatgaggacacataaaaccgctgctccataatttttgaacacttctctgtatttgctttctagattaatactatcatctaccttctcgatttcaagacttatatcatttatcaattctagtgaatacctcaaatcatttaaatattctttaatcctatactctttgtccgcccaaataaaaaaaacatttatacaaaagtctttgccaagatgtcccaagcgtctatatatccgagttatcattattttttagaaataaacaatcattaccttctaaaaatatttaaattaattttgggttactaataactttcccagtggtaagcacttttcgtatttgccataatatcttgttagatgataaatataaattttctcaattctcttgatttcttttttattaatccattttcaataaaatgaaacaacttagtaaaatctacttatgttcctttattcatatctgaactatcatatattttcttcatttttaaaatccacttttaataaattaaatacttcagatagatcactttccattgatatagcattttcataccttttaaaattgctaaaatataatcagcttttttaatgattattccaaaagattgtatttttttcttttcccgcacccatacagggttataagatacctgttgaatacagactgttctcatgaaaattgtcctcactttcctctctagtattaagcctttttctttcaattaaaatatctttctttttatatagcaaaaaaacttatttcattaattataatgaaacaagtttttttagttatttttactttattaatgatataaattatactttaatatttcagggaggaaatattaatagttattcatctcttaaaattttgctacctaatttggcatgaaagctagcatctttagttgtttgtatatcaataccttttaatgccgatactttttcacatatcataaataacaatattatatattcaaaagatacaaagtctttctttttcaaactatttacataaaaatcttttttatcagttaattttgttccaataataacaatattatttgtccattgcgataatactgtttttaatgtctccacccttggttctacattagtatctaataaaaataaataggaagaatcattgatagcattataaattccatgtgtaaactcttcaaattcataaccagatactggtactcttaaagtttctactaattttaaacttccttctaatgtaatgccaaatacatctttggttccaactacacgaatatcttttgcctttaccaatgtctttccatttttttgaatccactgctctgcatcatcaacgatgcttatgagattattacttacattcttatagctttgtaagaattttttatatgctgtttgatcaataattccatatgtttttgcccaatacactcctagtaacattaagttagcaatcgtacataacataccttttgttttgggttgtaaatccccttcttctccacatttaactgtcagtatataatctgcaacttcatttaatactactgcattatcatctctacccgacatagatgctatatggcatccgtgtttctttgcccttttcatagcacgatatgtacttaaacttgttccactttgcgatattcctattactaatgtagtttgagaattttgaaaaatataagattctatttcaaagggatataagacttctactggtatttgcatatactttaacatacattctttcgctgccactccagcatgataactagaaccagaaccagtaattataattttttgatatctattttttacaacttctttaaataagttctggtgattttctactatttccatcattcttatgggtgtttcacgaatacattgttccattgttaacatagttacttttctccttacaaccttctttttaacctaaaattcctaaatatgcaccaccaataccaataattgtcattaatacaatcatagtaataggttttatctttttaataacaattccccaataagtagttgcgaatactaacagtgaagctaagcatggcataatttgatttaataaatcagatactgtttggctattagcaccatcgctgaacgtatacacaatattgagatttactaaactcgcacacattcctcctactacaaatagtccaagtacagtagctccctttaataaaacgctcatcaatccatttgattgcatttctgttaaaaatttagttcctaaagaatatcctacattcattaatccaatacgaattgcaaaagctggaatattataaattaagaagaagagaatcggtcctaatatatttccttgtagggcaaaggtggtccctacagccgttgcaataatcttgaaagtcccccaaaagaaggcatcaccaactccagatatcggtcccattaatgctacttttgtttcattcactactttggtatcaaattctttatttttagcgatttcttcctccatcgcagaagcaattcctaagttaaacgtcatacattgattagttacattataatactcaagatgtctttttaatgctttagatgcttcttctttttgtggaaacagcttacgtaatacaggaatcattgcatatgcaaaggcaatatttccttgtctttcatatccccatgaaaaagagcagccacaagatctcaacattgttttatttaattcctttttcgttaatttagaagtcatcatttattcctccttctgttatcgcagctgtttctgttttattaatttcctgtttaataagaataatagctaatactgttccaaaaatagctacccctaaaattggtagttgtgaatacgcaacaactgcaaatccacaaatgaaaatataaatatttgatttagataacatagttctagctaacatactaaatccaattgctggcaataaaccaatagttacatttaatcctgtttgtacaaactcaggaatagcattcaatatatcactcataacatcactgccagctgcaaatgagacagttactaaaactcctaaaattgctgccatcgttaatccgcaagtccaatgcaatatctctatgcctctgtaatcaccttgctctgcaagtttatcggcacgtctttgaaataaagaaacaatgtacccataatgaaaatttttaaaaattaaagctaatgaagcaaccggtaatgctaaaaccatcgcactctctgcacttgctccagcattaataacaaatgcagttcccaaaatagtacctatcatagcatcaggtggaataactgccccaatagaagtagcccctaaaaatgctaattccaatgttgctcctatcacaattccagttcgtaaatctcccattaacaaaccaactacagttccggccattattggttgtgtaataaaatttctacctccagcatactcaataactataagagccgctgttactagtccaagaattattgctgttccaatcattttattctcctctctctcattttaaatatggtatagccttaacttctggcacacgctgtataaatatttctactcccctacctaacatctgttgtaattgtttttcttcttcaggcaatacataaaaggttttagctaattgttttcctccatcttttaccttggaattccctaaattaatctttcggatattttcacatccttctaataatctatatgcatcttctacagtttcaacaattattaatagtcggtattgattcgtaacatcactgttaatagcctttatagaattttctatatctttcatgaccagctttgttgaaggtggttttgccatataaatagctgtcttcttaagttcatccttcataattccatcattagcaatcaatatacagttagcgtttaaatagttagtccaactataagcaatctgcccatgcaacaagcgatggtctacacgcaacattaaaatcatataatcttcctcctctctttaaaattcatcattttgatatgatttttttacaatatcattgcaataacatatcatttgtttattttcttctaataacgcatgtatttgttcttcaatacttctattttcattgataatttgtaaaattaatgacatattcattcctgcaatcaaatgaaatacatacgtatttaatagtctaataaaactattattaacactaccaccatatatatcagtgatgacaattacttcatctccatcattaaaactttcaaatatttgtttaacttctgcttcaaatgaaaaatcttcttttgtatatgctgatatagtataaatgttattactatgtcctactataaaagtaacactatctttcataccttctgctaacattccatgtgaagctaaaattattcttctcataaattcctcctttatccctactattaaaattcatccgatcctacctttacactgatatcattcttaatgtattcgtacaaataggcaatctcattaattggtaaagtaactttataatgttctaaaatagacgcaaaacattcatttaccacctcaataaattcactattagaatttataaatccaggaatatcataatattcttctactgtttttttcgttaccaaacgttcaattaaaaaacaaatgtgcatattgattcccacaattgtcttgcttagaaatttgcgttttaatcgatgctgcaaagcgttagttgcctcataaacataatctagtaacttttgagcatttaatattgttagattttccataatagattgcaatgagaaatttttaagtaataactgatcaaattgttcaatttctttagtacttaaatattctgctaaaatctcatttaccatattaatattctcaaagttaataatttcttctaacgtcacatttctaacaccatctaattgtaagttcattggttttactaatagttcaacattatattgaacaaaaatagtatcctttttaccattttgtaataataattcgtagtcataagcaatcatttcaaccgctattgtttttggtaaactatctttaaataatcggcatagtttctctgcaatagatattccagcatcactagtaaacaaaattgctttatctttttttgcaatagaaatcatatgataatatactttggcttgtttacttacttcttccaatattgtttgtactttctttttttgtttaatcttatttccaatttctaaggccaatagcgtggaaatattattaataatgccaacatttgcaaaaccctcgatttcttttcctatttcttctaaagaacccatatcaaccattaagataatatttttgaaatgcctattatgttgaacaaacatatttagtttttctatcgtatcatctaccgaactatagatgggcatatcaattgcttcaaatacttgcatgtttagtaaagtatttactgcatctgcaatagaacttgccgttgaatacccatgacacaaaacaactccgatagtatctaacatttttgtgttcaagttatataacttcatatttaataaaataaatgattgttgaatcatagaaagagaaatacgataattattagtaatttgtttattaagcatcttacaaagctgttccgattcatttcctatttgcaataaatattcatataatctagttatctctgtgatatgctctttttcccaaacgtttaatccagaattatgattttgttgaaaaataattaatctagctagaacataagcaaaattaataggaaaattaatgatcgtggaacttcttactgtagttaaataatttgtaacgaatttttccaattgtctaactctacagtcatcgtatgtttcctgaaaaacaataacatcatagtagtgtttaataatcttcttactttcttctaaaaattctttctcacttttgcaatttgtatttaattgttcgaatgaatgaataatattattccacaatgatataatttgaattatcgaactatcaattttaatatcctttaacggcatacatttttcttcctcactggatatcttaactgttgataacatataatcaggtaaatgaaatacatatatatccaagttctcattatcagaatcaacataagcatttgcacaaatagacttaacgcatttttttagttctgttaaattgttgttatacgtttctctaattaatgaatataatagcttattagatatcgaaatatttttacctaaacactcctcttcctcatagaaaaaatgtaaaataagttcctttttttcatcttcatttctttcagaaaatgatggaatattgcatactacaggaattcttgattccaaaatttcacacatctgttctttttgacttgggatactactcagaataatacgaatatccttatatactcgtttctttcctttttttcgtaagaaggattttgataataaaaaatctgctaatttttcttgcgtattttctggtaaatatgatacattttgaatgtataaaattccatgatctaaagtatccataattccttctactgtttgtccgttgatttctgttccaaacaaaaacaaatcataatctatttctttttgttgctttgtaactttaaggtatttaaattgcgcatttgatggtattatttcttgatttatacaatagtgataaataatttcccctagatattttttccctgttccattttccccaactaacaatatgggtaatcctcctgggtatgcgattgcagatttaatttgttgtattacatagtgcaaacttccatccttgcctactacattttcaaaatccatcctaatagaatctttacatttaagtatttggcgcaattctaacatactcatatattcactttgtcttaatgctacatgatacttcttttccaaaattattttacttaaataatacacaggccttgaagtaatttttatagctgtgccattttttaccatatcatttaagtacatagaaactaaagatctagacagatgtaatgtctgacttatatactttgtagtgaaaatatccaaatttttattgtcaaattgtttcgttatttcatctaaatatttaacaacctgatgtttagaactatattgcgccataatttcacctcctctttcttatggctaaagtatattatatatttttattatgaactgtagttacaacctattttgacactatttatgcttaaaactgcttttttaacacttaattgtcctataatggcatgtgtttatttttatttacactatttcatagtgtaaataaaaataaacattgtaataaatttgtggtaatctatattttaataaaggatattataatgcggttgaattgacatttccgacagatgtaagagaatgtattatacttattggtaaagctacaattggaaatgttgtaaataaatatttcaaaatatttttccaattaaattaagaaagtgaattaggaatatataccgattgtgttctctttgtattataatattcaatatattcttccattgcaatcttatatgccacctatatgaaattatatttgatttgttttttcatgaaatatggatacctcttatttaattgatctttttttataatataactttataaaaaagcatagtgagtagctagtaccatacaattactactcacttgatttacttcgatccagaaagattaaagtagaattatcaaagtcaggatatcaagttagcgttcgaaaaattcgtcgtattatgcaagaaaatggcctggtttctaactatacagtaaaacaatataaaatacataagagtacatgcaataatgataaagtagaaaatatagtacatcgtgaatttgatagagaaaaaacattagatgtagtagtaagtgatcttacctatgtaaatgtaggtggttattggaattatatatgtttactactggatttatataatcgagaaattattgggtatgcagcaggtaaacataaagatgcaaaattagtatataaggccttcagcagagtacaaagaaacctgaataatattcaactatttcacacagacagaggaaatgaatataagaataggataattgataaagtactagaaacatttaatgttagtagatcgttaagtgctaaaggatgtccctatgataatgcagcagctgaagccacctataaaatcataaaaacagaatttgcatttaatagaatatttaatagttttgaagagctggaattagaattatttgattatgtaaactggtataataacattcgcattcatggatcattaggatatgtatcaccagttgaatataggataaattctctttgaaattgtcctaaaaagtgttgacaatccaaaatgcgacaggttcaagaaatgacttactttacaaatctgcctaaggaggaatttgaaaaaagaaagatagaagatttgtattcaaaacgatgggatattaaagttgcgtacaaaacattaaaaactcaattagaacttgaaagaaatgtatcaactaatgtttaagttgtacaaacgagtgtatatgcaaaagttttgttttacgctatatgtaattgagttgaacttaataattaaaagaaataagaatttgacactctcatttctttgtttctaaataatctataatatctataagctgatcaacgataaattgagcatgactttgacgtagttaatgcataatgtataagttgttgacttgatgatgatgcaagtgctattttgtagttatgtaactttaaatagtcgagtagggagaaaatatatggattgagtatggcttggtaatctctttttaaagaggcataatacttagttaataaatcattaaattcttctcttgaagttttttcattccaccagccatacacaatatctctaaacttacgattatcaacacatatcacttgtttatattcatcaagtaataaatcaatgtcatattttttataaaatgccataagttcattcatatacattgtttcactatcaaagataacaccgtccatatcaaagataacagttgttttatgattcatgattaataatctaatgctttataataacgtctaatatcaattggatgacgtctacaatgttctaagtgtacatttaatctcataaatgctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttataataacgtctaatatcaattggatgacgtctacaatgttctaagtgtacatttaatctcataaatgctgatctcatcatgataggagataaaattcctctaaactcatcacttattccttttaattcataatcttttgtatcaaaaacagtaacttttgcactgactctatgaacaaagttttctacacgatccatttctggacgagttttatcttcacctttaatcaaaataactggaatatctctttcaataacttctaatgttccatggaagaagtttgctgctgaaattggtcttgttcgcatccattgcatttcttccataatacacataccatagcacactgcccaatcttctaggtttcctgatgcaactaaataagtaattggttcatcacaatattgttttgcgtatgcttccattttagcatcagcatctttataaatttgtacaacattttctggcatgtttttaatctcattcatcaattgatcatatttatcaaattgtcccgcatttttcataaagcgtaatacaactgaataccaccaataatattcaccaccgaatgtatttactaaataatcaacttttttagccaaaggagaatttaaaacttcaacatatcccataactttggctcctacttcatgtgctttatcaatagctgcttcaatttcaatagtattacctgataatgatgcaataactacaattgatttttcattaaatttagcattcccttcatataagaaatcagttgcattttctaaataaattggtaaatcacaaccaagttgtttagcagtatgcataatttgtcctgcatacaataatgttccaccaattccaaataagaagatatttgaatacccatcttcacaaactttatcaacaattttttctacttcagggattaaatttactccattttgatgttctgttcttactctgctttcatcgaaatttaacatttttctctttgattcttcaactatttgtattgctgatgatgcacctataacgtctgctcctgatttgaaaaatttttctgcttgttgatatgttcgtattcctccagaagcttttatgcatatattatcatctagaatatttttcattagtttaacatcatttaaatctgcgcctcgaaagcttcttcctgtcgatgttttcaaaaaagtaggttttacacgattggcaatattacaaatttctctttttatattgtctctaccttcaagtttacacatttctacaataactttttcagctattccatatttctggcatatttcatgaatagaaaacatttcttcttctattttttttagatttccattttcaactgcattttgatttaatacataatctatttctttataccctattaatgcatattctttaaatttattaactttttcttctaatgttaatacaccttctggaaaatctattgcaccggcaataataatatcatcattcaaagcattcacagcatattcatattcttgctttgttctagcaaaaatacagcgaaatccatatttgtttgctttatccaaataagttttaaaatcatcttgaggatctcttatatagtctaattttttagcaatatttaacatatttctttcctccacttatcaaataaaaattttgattttttatctgcttcaaaaggttttctataatacacacgattaacaatttcaaaagaaagcaatcctgtatagttatatttttttaatgtatttaaatcttgtgacatgcatcgtgtgccatctccccatgccatatgaccagttggattcccatcaacaaaatgacaatgaataattctacttccaaaagcttcaaaataatcatttatattttctttagcttttgccattgctcctaaatctaaacagatttttaaattatcatgattaactaaatcgagaaaatcctttaagtctgaaattgtattcaccaaaattgattccattggctgtaaagcctctatcgctaaaggaatatttttagatgctccatattgagccaaacgattcaacatttttgcacttctttgttttgcatcatccttattttctaataaatacgcccatccactagtaacaacaacttgattcgcatttatctcataagcaatatcaatcgcatttttaaaataggcaaatactctttcttgttcttttgtagatttagcagccatattattcggttttggatttgtttgttctggacaaacaccaattacttttaatttatatttacgttccaattgtcttaaattttcaactggatcatacccattataatccaaataaaaatgcatcggtcctgtccaaagttcaacatattgaaatccattttcgaaagactttttaaaaaaatcttctaatgtataaaaacgataatgacaattcattgcacatacatccatatatatctctcccttttcatttgtaataaatgataatggcaatatggtataggtatacataatgccattatccatattatcaatgtattaataattcaaagctttataataacgtctaatatcaattggatgacgtctacaatgttctaagtgtacatttaatctcataaatgctgatctcatcatgataggagataaaattcctctaaactcatcacttattccttttaattcataatcttttgtatcaaaaacagtaacttttgcactgactctatgaacaaagttttctacacgatccatttctggacgagttttatcttcacctttaatcaaaataactggaatatctctttcaataacttctaatgttccatggaagaagtttgctgctgaaattggtcttgttcgcatccattgcatttcttccataatacacataccatagcacactgcccaatcttctaggtttcctgatgcaactaaataagtaattggttcatcacaatattgttttgcgtatgcttccattttagcatcagcatctttataaatttgtacaacattttctggcatgtttttaatctcattcatcaattgatcatatttatcaaattgtcccgcatttttcataaagcgtaatacaactgaataccaccaataatattcaccaccgaatgtatttactaaataatcaacttttttagccaaaggagaatttaaaacttcaacatatcccataactttggctcctacttcatgtgctttatcaatagctgcttcaatttcaatagtattacctgataatgatgcaataactacaattgatttttcattaaatttagcattcccttcatataagaaatcagttgcattttctaaataaattggtaaatcacaaccaagttgtttagcagtatgcataatttgtcctgcatacaataatgttccaccaattccaaataagaagatatttgaatacccatcttcacaaactttatcaacaattttttctacttcagggattaaatttactccattttgatgttctgttcttactctgctttcatcgaaatttaacatttttctttcctccatttattttcttatcctaaaattccaaattgtgcacagacaataccaataattgctgtaccaataattagccataatacattaacctttttttgtagaagtttataataaatacctgttgttgccaatgctaacatccctggcataattccatttaaaatatcctgaatttttgtagcgctttcgccacttccaatgactagaggagtcgatactactactaattcatttgtcattccaccaataaccattactcctaaaattgctgctgctaacatgaatttttccattaatccagaactttgaattttttctaaataagttgctccaagttcataacctttcatagcacagatatatcttaaaacgaatgctggaacattgaaaattaataagaataaaattggccctaaaatatttccttgcattgctaaagatgtccctataccaattgctaatactcttaatgtcccaagtaataatgaatcaccaataccacttaatggacccattaatgcagctttaacagcattaattgatgatgaatcaaaatcttcttgtgttgcattcatttcttccattgctaaagtaatcccaccaacaaaagttgaaacatgtggtgttatattaaagaactctaaatgtctttgaagtgcttctgatagtcctttgggatcatttctgtatatcttctttaatcctgcacttatcatactacaaaatcccatgtgcatttgtctttcgtaatgccatgaaaattccattggtaacgatctccaaaacatttttattaaatctttttttgtaataactttttcattattagaagtcttcgtcatcttcatatcctccttctgccattactaaattattattatttttaaaatcaatctttaagaatacagcaattacaccaagaatagcaattcctacaactggaattttaaaatatgctgataaaacaaatcctaagaagaaaaatggaataactttcttattcataatcatttgagctaacattgcaaatccaattccaggtaataaaccacatgcaattgataatccatcagtaataaccgcaggaattgcattaacaatagcttccatttgtgaacttcctaaggcaaatcctaaaaaagtaatcaaaaataatactgaacatgtaataaaaccagttcccatatgtactatagttattgctttagcattacctttagcagcatatttatctgcaatttttgccataaatggtcttactaaagaaaaaataacattgtcaattgcttgagctaataaagcaattggaaaggccatagtaaaagcaatttctgcacctttacctgtagtaattgcaaatgctgtacctagtactccaccaacaataacatttggtggaatatatgcaccaacagaaacttgccctaaaaacgctaattctaaagttgcacctacaacaattcccatttgtaaatcccctaaaatcaaaccaaccaatggaccaagcacgatcggtctttgtattaagtttgtacctgttgctaaatcacattttccaataaatgctacgcaacctaataaaaacgcctgtaacataattcttcttcctctctatataacatcttttgcatcaattttcttgtcggttggaaccatacgaatttctacagaatactctttattcaataaatctttaacaagttcaatttctttttctgttaaattcactgccttagaaatattctttgtttcagcagtagccttagttccacccaaaacaacactatcaatcacatgagtttcagtcattaaacgatatgcatctttaacgctctcaacaacaataaatagtttgtatttatctgttacaccactattgattgactgaatggcataatcaatattttttaaaaccaactttactccttgtggtttggccatcttaatagccatttttttcaattcatcttgcataagtgcatcattagcaatcaaaatacaatctgctccaagagcacttgtccaagagaatgcaacttgtccatgtagtagtcgatgatcaactcttaaacatttaatcataacttcttccccttttactaaaattcttcttcttcaatatctttttttaaagttacactattttccaatgtgattcctacttttccactatctaatacatgatcaatatttacatttccggaattattagatataaccaattcaagaaccatattcatattcataccagaggtaagattcactctttcattattacacgtctgcaataatgcattataaacgctacctcctttaacatcgcatacaatcacataatcttttgtatctgcttcaattctcttttttaaagaagcagcataatcatttggattttcaccaggatataaactatatgtttcaatatcttttgcaagttctccaacaatcattgaaactgagtttaacattcctttagataaatcaccatgtgatgctaaaattatttttaccataacgtccactcctttcactgattaccgagcaagaagcgtgccaaaataataaatgtactttaatttttttatttttttgttgaagttaccggacacttatatttgagcaaaactcgtgccaaaataaaaatccatataaacctattttgtttatatggacatatattaatcattttctacataagagtaaatatattcaatttcttcagttgggatttcaacattatagaattcctcaacctttttcatagattgttttaaagctataataaaatcttgatgtttctcttcaaaatcctcactattatatactgttatctgttgtttcatgattaatctttcaatcaagcaactgatatgtatatacaagccaaagcatgtttctttttaaattgatgatttaatattttttgtagttcatctaaagcagtagaaacttgttcaagaagtttgtttggatttaggattgttaaattgttcataacattcgataacgagaaatttttaagaatatttttttcaaagataagcagttgatcatttgaaagataatctttaaaatactgctctaatttatcatgttcactattaataataaaatcttcgattcctataaatggtaaatcactcatattagggtttaatgttcctacaacacatacgatattgtaatcttctaaaaattggcgatcagtatgattttgaataagcgatggataatcatatgtcaaaactttcatatttaatccttttggtaatgaatcggtaataattgttttcaatttttctgcagcaccaatgccactagcacaactgcataaaataattggttctttttggtgatgaagttcaaggtggacatgataaggattgtttttgttgatgtcttcaaaaatgtcttgcatagagcgttgttgtttaattcccatgccaatttctaaagcgagtttggtattaacattgtttatcatggctatatctacattttttatttgtattccttgatatatttcttctaaagatcccatatcaaccaataaatataaatgtttaattttccccatataagataaataattattgatcttgttaataattgtcgtgctatccacatttaacggcatatcaatagcatcaaaaacatatgtatctaataatttatttgctgattcagcaatagaacttgcagttgaataaccatgtgccaatataatcgcaagtgtttggtttaatgaatcatgattcatatatttatttaaaataatcatcataatgacttgtaccattgcatcataagcatcattgatattattttttaaatagtcatagacttcatctgctattaagtattctctatgaaactttgcttttaagttttcttgaaaacaataaatggtttgttcattctcatttacccattttgccagtttataagtattatgattatattccaataaatagcttgtgagtgcaataacctcattatgcgacattttaaaaccatagcgattcgtcatcatgtctaatacatgacctacagtatctaagagatagttattttgacttaaatcttttttatcaaatacaattttttcaaagtaatcttcaataagttttcttgattgtgttatgaaatcttcttgattatgaagatgaattaaattttcataaaaatgaatagtacgattttgtaaagatgttggaataagtgtatcgagtgataacatttgatgtttcttcatcattaattgtgctggattaaccatttccataatagtttgaggaaaatgataagcatgaatttctagtttatcatcttggcaattgaataatgcactcacacaacttgattgaatcacattgcttaattccccaatatttcctataaaattatgatttaatagaagctgataaacattagaagaaatccgaatcgttttctttatccttttttcttctttatgataaagggaataaatcaattgtactctttcattaacccctctttgtgataaagagggaatttgtaaaataacaggtattcttcttaaaagtgtttttaaaagaacctgctctggatcttctgttgttgcaaaaataatacgacaatgtgattgatgccatttatcattatcacccatcatatgataaattccttgatccatgtataaaaataatttttcttggcattccgctttcaaacaatgtacttcatctaaaaataatactcctccattagcataatgaagcaatcctaaattatctttatctgcacctgtaaaggcaccacgcttatagccaaacaaattagccgttaataactctggattgtttgcatattctgaacaattgacttgtacaaattgtttatctttttcaatcaatctcttgtttatacaatattcataggttagcttagcaaggaaagattttccagtacccgtaggtccatttagtaatattggtaatcctaccggtggatatgatactgttgcttttattttttcaacaagatggttgagactatcgttatatccaatgagtttttcaaaatcatgtaaaatatgttcattttctaattccataagtaaatcttgtaattgtgagtattcctttttcaaatgctcttttttatattttgtttgtagataatctttatctaaaaatatgattggtctttgttttattttgatgaatacatcttgttcatacaattcattacataaggtagaaacataattacgactttgtttgagttgttgagatatttctatacaagtacatttatcaaatgctttttgatcaataaattggtgaatacaatctaatattttcttttccatgatttcaccttcctttgttgttatcttaatcatttcaattacgactgtcaaggtctatttttttactctttttctacatattttggcatgaattttgctactatataggtagaggtgattgtgatgaagcaaaagtttagaatgaaacaaacttataaacaaacttttcaattaaatcaaaaaatgattcattcccttgattttttaaagttaaacagtgaagatatgcaaagtcttattgataatgctttacaaacaaacccttttttagaattaaggaaagcatatgatccttcaaatcattcttacattgaaaatatttctaatcatccttctttacaagaggaattatatcaccaactttatgcttgtttaaaatcttatgattctcatattatgtcttatcttattgaatctttaaatgatcgtggatttttaagttatagttatgatgtttatttaaaagaattacagattgatgaaaatacattttttaagcatttagaacttttacagtcttttgaacctgctggtgtcgctgctagtgatgctattgattctatatgtattcagttaaagagaaaaggcaaggaaaatgcttattgtttgatgaagaaatacaaagatattattcttacgcagaattatcatcaaatcaaacaaacaacccatcttacacaaagagaaattgatattctttttgaagatattaagcaatgtcagccatttccatgtcaaaattattcaaatcaaaatgatatttatgttttaccagatattgatattattattgaaaatgaaaatattcaaattgtccctattaaccaaccaaatgtgatggtaaatgatcatctctatcaaagtgttagagataacgaagatatgaaaaacttttttaatgaagctcattttcttttggaaaacttaaccaaaagaaataagactgtcttaatggtagctaatgaattggttgacttacaaaaaagttattttctctataatgatgaattggtttcttgtacgttagctgacttagcacaaaaatgcggttttcatgaatctacgatatctcgtacacttcatcataaatattatcgttttaataatgaggtttatcctttaaagaacttattggtatctaaaactttaagtggtgatagtagtgattctatcaaaaaggcaattgtcttattaattcacaatgaagataaacaaaagcctttaactgatgaagccatagtttctaagttagaagaactggatttatattgttccagacgagtgattgtaaaatatcgccaacaattaaatataccctcatcttctaagcgaaaaagaaaatagtcttttaaagtatttaaaaaatgccttttgtctatcaaagaacacaatggggtcaacttaagaaatactttgtttttaacagctctaacaaacataataagacaatttactcgcttgattaattctttttctaatattattcattccaaaatcgttaataatttatgtcgaactcgttttcaggattttatcggaatacgtgtcatgacttttgatatagttgttttctaacttatattcagaaacagaaaaaatactgatgcagatcttattaaatttttctcatgtcttgatatttttgaaaagaaaattaccaaacaggctatgcataagaatatcagaaaacttaattcaaatgttttttcattattaatttaaacagtttgctcaattattttattcctcaggattaagcttatactatactataagggttacacacttctcggtggggacggtactttttagaaatttcatatgatacctataatatcaattactttggcatatggtaaaaccaacatgtttgtgatatgtttgatgtgaaaaagattgtttccaaaccagctggtctatatgatatcactaatggcatttttgttgatttcacaacaaaaacaggcaacccattcagaaatgccacttgcacttcaacatttatatgctacaagtgatttgtacaaagatatgaaagtcatatatttagctgataggtgctatggctctgctgggttgatctgtttttttgattatcttggatattattactgcattagaggaaagtcatatttttacaaaaaccaaatttcacagatgaaatcaaacgatgaatatataacgactaatattaatgataagtggcttaagagattttcattctctcctgaggcaattgaatatagaagaaaaaattccgaattaaaaataagagtcgttaaaagaaattacatatattatgatgagctagaaatgcgacaggttcaagaaatgacttactttacaaatctgcctaaggaggaatttgaaaaaagaaagatggaagatctgtattcaaaacgatgggatattgaagttgcgtacaaaacattaaaaactcaattagaacttgaaagaaatgtatcaactaatgtctaagttgtacaaacgaatgtatatgcaaagttttgttttacaatatggcgggaatactaagaaaacaaattaatcgagaacttatgagtcatccaaaacagaatgaaacaaaagagtataaagaaaatgtaattgtatttgaatctcaatattgggttgtcaacatatcacagcttatcaactgttttatggaaaataatattttagtagcatgttcaataaaaacaagagagcgatagtgaaaagatatatcagatgttaaaagcatgtgagaaactaaaagtgcctattcaagagaatagacactttgaatgatgaagtcgagttgttccgagcggattttatacccgttttacacttgatgatcgaaactttccaacagtaaaaaccgtcaatggtgtaatgaaaacaaccaaactgtagttaaatattacacgataatcatagtacattacaatttcaaaaaaatgataaattttacatagggattttatgcatttttttacgtgttttaattggaaatatcaattgattaattatgttagtacaatggaaagaaaaggtaatacagatagcatatttacccactctctccttaaacgaaatacactacattaatgtattctaaatgagaaattaagacacccacttatatttgttgaaatagaattaaagattataataattgagcctgtaaattattttgtgtaaagtctgttcccaatgatagaatttgatgagtaactgtattgagtaattatacagttacttttttatatcatatcataatatatttaattgtaaatgttctcgttaaaccctcccttcaaagatgatttgaagactagaatatataattccccaattaccatatgggacattccatttacttgctattttatcttgagctaagtacaaagatttaaataaactttcatctgttgggaatactgttcttattttagtaaactttctaaatgttctctttctacacattctactatatccataacgttcttcgtcatataatcttataatttctttcttgtccatataagttaattttgccataataaaaccccaaagattgtacttgttatattagtccaatctttggggttcatttcaaacgaactacacacttaaacactaattatttgattttataaaatggattttaaactgtttatatccatttatttatatcgtttgactttttattcttgtagtttaattattcaaaatttgtatgtctttgaaacatactatctgaattttcgtttaattttttcattaattctaatataattgcatcataaacaagaaatgaaagctgctcaaaagcagaggccataggttgcttacttttaccagataatttagaagcacctggtaacacaactatactatcagccaaagaagctatagtagaattttcgtttattgttataagagcaactcttacctgttcatcttttgctgtttgagcaatagacacaagacttggcgtttcacctgatcccgatccaataataagtaaatctccagactttgaatgaggagaagtaatttctccgactaaactaactgaaaatcccagatgcataagtctatttgcaaacgcagaaataatcagaccagagcgtccttttcccaataaatatatatgatgagctttcactatttctttaataaaattttgaaaatcattatcatttactatctgactgttttgctttaattcatttaaaataatctctaaattattttttacactcatattttttgcctttctttaataaatttttaattctttctgtaatatttccattaaaaatatatccaccagacacaaacacattcactcccgtttttaaacactctactattgtttcatcagtgatattaccatcaacttgaatatcataataaaaattattatcttccttgagttttgctagttctttcattttgtgaagagttgagtttataaatttttgtccaggtactccaggattaatagtcataactagcacttgatcaacaagtgggagcatctctttaatcatgcatactggtgtcgcaggattaattgctacacctgccctttttcctaatgcatgaatcatttgtataactctataaagatgtcttgttgattcgtaatgtacagtaataatatctgcattcttgtaattatcaatatatctttcaggattttctatcatcaaatgtacatctaaaataaactctgttttttcttttaaatcattaaccgtatttgacccaaatgcttgattaggtacaaaatgtccgtccatcacatcaatatgtaaatatgttgctcctgcacttttaacttcttttaattgttcaaccagatcataagtatttgcatttaatagtgaaggtgatataatcattaaaatcatctccttataataaagggtatctttcgaggttttatttcaagccatgatatttgaaactgcttttcaaaatcttgtggttttaatatatgtagtaaaaacagacctcttctgtttcatgaggtctgcttttttgctttatattactttgatatcatgtcataattatttaaatatatagaaagtaaaaaggatgatacccaacatcgccaaacgtcacttatcatcctctgtcaaaagacatgattataataactgattactctataaaactcaatacttccaaagctaaaaatgattttgatgctcttataaaattcagaaaactatattctgatctcatttcttcattttctttatcttctattgaatgcacctgtggcagtcataactggcatatgcattcttcctattctcgcttctatgattttcttggaagaaaaatcaaagtttccattcagcgtattatctgtgcttcatgcggtaaaactcatgctctgcttattgaagatatgattcctttttctacttttacattctctcaaatcatcgactgtcttgatgatcctgatttctctgtggataactttcacagatcttttctgatcaacaaatattataacgttgaacaaaattaccgttcatactgtcaaataaaccgaagaaatcatatgcttatttttcttccaacataacttttatctttttttctgttcttttcattatcatttaagtaaagataaacagaaggagatgattttgaaatgaatttgaacaaatttttatatagcgctggtgatttctatgaaacctgataccaatactatgtccactgatcacaacagtgatgtattaaaaatatttggtattgatagtaacatcattgaacattacgatatcttccatagaaaagatggtgtccatattatcttgaaacttataaacagagaacagcgttgccctgtttgccagaccagaacaactaaagttgtcaattacatagataagaaaataaaacattctgttgtttccacttcctcttgtttcattgattatcatgcccgacgttacagatgtcctgcatgcaacaagactttttatgaatccaatccttttacttttggaacggaaaggatctcgtcagctaccgtttatagtgttctgcaggatcttaaaaagccatttgaaacatttaaaagtgttggtgaaagatatcatatatccaccaatacagtcatcaacatatttgacagatatatcagtacaccaaggcttcccatgccatctgtactttcaatagatgaagtatatgttccaaccgatgacagaaacaaatatctctgcatactttttgattttgaaacaaagatgatcatcgatgtcctgccatcaagacataaaaatgtgttatcggcctattttcatagcgttcctcttgatgaaagaaaaaatgttgaatatatgtcatccgatatgtgggtatcctaccacgacatatcaaaaatattcttacccgatactatcaggacaattgacagattccacctccttatggagttttcaaaaaaatttaattcaatcagatgtgaaacaatgaaaaaatatgcacttactaaaaatgcctatcagaaagaaaaaacaaaaagaaaactgaaacctgatgaagaagcaatctatagagaagcatgtatcaactattacgcctttaaaaaattcagctggcttttctataaaactgattctgatattttaaatccaaacaacgataagaagttcaacagggtattcaaccgatatatgaatttttatgatatccatgaacatatctgttcatgtgataatggttttgaagaaatatgcaatctaaaatatgatctcgatatgttctttaaaaacagtacagtcgaaaccgcaaaagagaaccttgaaaatttaataaaggattttaaagaaaatgaccgtgatgaaatgaagaacttcgcaggtactctttcccgttggaaaaatgaaatcatttattcttttacgatcatcggtgaatcaactatcaataacgggcgcatagaaaatataaaccgaacgattaagaccatcaaaagaaatgcgaacggatataaaaactttgagcgcttaagaagacgcataatgtggtgtgtaaacaagcagggaaatataatactcagtcaaagaaaggaaaatgaatcatgaaaaaatatacagtgattgtagatgaagattatcaggcgtttaatgaaaactgcaatataacgctagatgaaattgatttaaaaatacaggccctaaacaaggagttggaagacataaagaatatagctttgaaaaactatgatatcctagataaacttttcgaactcagacatgtagatttttagacaatataaaaccatgaggtgtctcatttgagatttgcctcatggtttctcattagctctatttcaaaaatatcatgttatttcataaagcccaattctcaataatcgcataatacttttcattacaaataattaccttctattgatttcaatagataataccattttacttgttaagtaagtagcatattccaatatagcaattcttccaaatatatcttgatacttcgtttcaatttcaaaaacaagatcatccatttcaccatgaaggaaatctgctctttctttagaaattggcatagaatttaattttctaaaagcttttaccaattgaattccatacatattttcaataacttctataattgtcttattcattgataataaaatataattttcaatatttaagaaatattgacagggtatataagtttctatcattgagataggatattctaactcatgtgttactcttataatatgtaatagttcactattttctggtaattgaaatcttaaattcattttagcatctacaatcttttctattttaacaattttagaattttcttctatatctggtatatttctttcaaaagaaaaactaataaattctttaaataaagaattcttatttgttacctttttaacaaatgttccactaccttttcttctttcaataagtctttcttttattaattcatcatatgcttgacgtaccactggtctagaaatagaaaattgtttacataattcttcctcagttggtaatctatcgttaggtttatattcacctttaagaatagcatctttaatatgttctttgagttgataatatagtggtaatgctgaatttctatttaaataaacatatcgttgatctaataattttttttccatcatctcaccttttatcctcataaatataaaaaacaaacattctattgttctgctttaaatccctttaaaatatccattgaacaacttgtaccaattctttgtgctcctgcttctataaatttttggcaagtttcccaatctcttatacctccagcagcttttactttcacactgtccccaacaatacttttcatcaataaaacatcttctattaaagctccacctgttccaaatcctgtacttgttttaataaaatctggtttaacaactttggctatttctgctaatctctttatttcttctttttctaaataacaattctcaaaaataacttttgaaataacatctttttctttacaaagagaaactatactttccatttctttttgaatataagcaaaatctccttgtttcacttttccaatattaacaacataatctatttcatcagcaccatcatctattgctttctttgtttcatatagttttacatccaatgatgtttgtcctaatgggaaagaaatagcagcaccaacatgaatatctgttccctttaataactctttacataagcgaacaggttcactattaatagcaaccattgcaacacccatatcttttgcctcttggcacaatctgatgaagtcgttatctgtggcatatgccttcaaaaatgtatgatcaaacatttttgctaattctttttctgtcattttttttaccttctttcgttatatcatactttttagctattttcaaaaaaagttttactatttattgacattatatgacatattatactcttttataatcgttctgaacagtctcttgtcgttctaaatacatatttaatattattccaaaaataataataactccacctattaaagatatctttccaacagtttcatgaaatatcaagaaagcccataatggtgctaataaaacttctgacatacaaatgacattagctgtaaaggcatttacaacctgtatacctttagcaaagaaaataccacctaatgctgaaacaaatattccacttaaaatcattgagacccactctaaaggttgaacactaggaaaatctttaaatacataaaaaataaatgaaatagaaatacaataacttaacatattagaagtataagtatttgcattttctttagtatttaaataaaattgcaaaccaaaaaaagcacctgaaataatagctaaaatatttcctatcataccttttattgataaagcatcaaaaaagaaaagaaccattccaaatataaccattaaaataattaatatttgtttcttttgtggtaagcttctataatctatacattgataaataagtacaaaagccatagaagtatattgtaaaacaatagcatttcctactgttgttaattggtttgcatagttaaatgttattcctgaaataaattgacaaatagcaatacatatgatcaatttattaaacacaatttttttataattaaaaagtctattaaagataacagctacaatggaagaaacaacagcaatcattaatccagattgactattaaaacgaattaatattcctgctacactccaactgattgcagttaaaaacaaataaccataaccttttaaaatcatataccttcttctaattcctcttcattataagttgtataagtatattgacaaatcattgactttcctgtttctatcatttgttttgttaattgtttaacatcattatgtacttggcaaagtaaatatgcttcaactaacattggtaaatttgttcctgcaataatttctacattttcttttgaagttcctaaaatgactgatgatttaaaaggtgatccccctatcaaatcacataaaattaatattccttcacaatcttttaattcatctaatgcttgttttatcttttcttctaatctttcaacagagtcatccattttaaaatcaatatagtgataatttatcaattcatttccttgaatcacttttaaagcttcagtcattcctgaagcaaattgtccatgtcctgtaactataagtccaatcatcaattaatcctcctttataattgctttttttatatactctaaaatatctttatgtgaagaaaattctaattgtgctgcacttaaatcaaattgataatattgatttttaattgctaaaacatctaatcctgctaaacaagcagcctcaattccatattctgaatcttcaataacataaatattttctcttggtatttctaataatgaaactgcataattataaattgctggatctggttttgatctttcaaacatatctccactaattatgcaatcaaacattgcattcaacccacattcattaaccatattttttatttcatttaaaatattagaagaagcaatggctatttttatatgctttgatttgagataagtaataagctctttaactccctctaacatatattttcgatattccataggatacttttcacaatatttttgccttaaatccataatctcctcttttgataaataaatatatcgtgataaaatctctacttccttttctaaagaacatccataaaattctcttttatctgcatcagatagcgtttttccatatttttgaaccatactttcaaatatatattgccaatgtgcttcactatctactatgactccatccatatcaaaaataacagcttttaactctttgtttggatatgcttttccaaaagccccattttgcatacaaatatttgaagcatataaagaagcattattcattgccttttcaatccattccttttttatcgtttgtttctttttccatccttgattaacaagagaatatacaaatgcagttatataagcatcacctgcacccattgtatcttttgcttttatttgatgttttacaccttcaatccattcatttcctgtaaagaataatggtatctcattgcctcttgttattaatataggtttatgtattgaataactattgattttttctttaatgtcttgaattgataaatgattcatagaaaattgtactaaatcaatatatggaatgaccttttgaaaataagtctcttgtctatatttttccttttctccaaaatcatatgacacaatacctgaaatatcttttagcaaataaagttgatcttctaatttagcattacaatttgtaaaaacaacatcaaaagtatgaatatattccaaatcttttggtaataagtgaataggtcctgtccaacattgtcctaaatcaacctttataaattgtctttcaccatctataacatcttgaatgcattgttttgttgatgtattgtttaaataatgacaatgagttatatcaatattcaaactctttaaaattgattttaaataataaccataacaatcatctgcaatatatcctaaataagcactttcaattcctaattgagtagcattaacagctacgttaacagcatttcctcctggataagaaatatttaaattctgatagacatcaaagacattatcacctaatcctaatattttcattagtaatctactttcctataatatctacgtatatctaatgaatgattagtaataacttccatattttttgaaattctttgtaatattgcattcataacaacaggtgatagtagtggtctaaattcatcagaaatatgtggatatacaaaatctttacaatcaaaaacagttaatttattagtatatttttcaagaaatttttttactcttaaatctaaagatcttgtttttccttctgtaattaataatgttgtacaaacatctttttcaattagttccaatgttccatgaaaaaactcggaacttgatactgattttgttcttatccattgactttcttctaatacacacatagcatatgaataacaaacaggccataaattacctgaagctatccatatttgatagggctcattatgataatttttacaatattcaattgctttatcatcaacagttttacgaactgatacaagcactgctggtaactcttttaattcatctgcaaattgattgtattgatcaaaaaatccttgattgtttaaaattttaccaattaataaatataaaactaactcttgaggtctgccttcttcataaacaaagctataatcgcttaatttttctaatggtgaatctttctttccaacaattgaaacaatagtgcagcctttttcttttaaatattgagcacctgctactgtttctggtgtatctcctgatttactagacataaagactaatgaattttggtttaattgattatgtcctgtcataacgagagtacttgataaaacacaataaactggaataggactcatttcattaatcatatctgcaaaaggttccatcattgcttgtgaacctcctactgatgaaaagaatatattactcaatccttgttgacatatattgtttgctattgcttctaattgatttctagcttcataaataaacaaaccattatctatcattttattttcatcaaaattaatcatttttattaattcctttctattgtttttataaaaatagccccatcgatgaaatggagctattattatcttataaaagttatttagaaattacatccatccaaggaatgacataagaattccaaataaaataattcctaatataataacaagaactttagcattctttttcttaaacaaccagtaaattaagaaaacaatggctaatggtaacatatttggtaaaataccatcaaagacactttgaacagttgttccttcacccattccaaattttaaactttcactaaatgctaaagaaatatatgaaggaattaagccaccaacaaccataacacctaaaatacctgctgcttttgttatatattttgttccttcagaaatagtagaaacagctttaactcctaatttatatccaaaagacccaaaccaaatacgtgatatagctgcaacaatccaaattccaatatataaaagtggtcctagaattgatccatcttgtgctaatgaacagcaaatagccgcagaaattggtaatactgtaaaccagaagattgcatctcctaatcctgcaaaaggtccaaacaaaccattacgtataccttcaattaactttctatcttctccatgttcctccatagaaagaataagtcccattaaaaatgttgccatatgaggttctgtattaataaattccatattatatgtcataaattcagccatatcttcctttgaatctccaaagattttttcagctgctggcaacatagataatgtaaatcctggtgcttgcatacgttcaaaactaaatgacgcttgttctaaaaaagaaaggactgacatttttgtaatatcttttttagttaatttacctctaggttttccattttttaataattttctagattccatcttcttcacctccgaaatcattaacagttattttagctgctgattcttcaactttcttttcatgcatataattaatataagcaagacaaacaccaacaactgcaattggtaatacatttggtaaatctaagaatgttgccataataaatcctaagaataaataaggtgcattttctttatttaaagaaaccattaataataatcccaatccaacagctggtaaaattcctccagctatttcaaacccatgaactaaccaagttgggaatgtgtttacaaatgattgaataggtgtttgtaatgcataagaacataagaatactaaaaatccagtaactaacgctttcaataaccatcctgaaacaactaactttctaaatctatttatatctccattgactgcataagtatcacatttatgtgcaatacctacataaagtgtattgaagaaaattccaacccattgtgctaataaagcaaaaggtaatgataagccaagtgctgttttcgcatcttgcccagttgtatatgcaataacaaatgtcatcatccctgccattaatggatctggtggaactgttccaccaactgtcaataatcccaaataagacaattcagcaactgcaccacatgcaatacctaattgaacatctcccacaactatacctgcaaaaaacgctacaaccaaaggtctaaaccaataaaagttttctaatcctgcatcaagagcacaaataaatcctactaaaaaaagtaatataccttggatcaatgtaatctccataaataaacctcccttatatatttttattaaattgtatatttcttatctcctggtgcaatttgaatatatacgtctacaccatttgatttcatagcttcaaaatcttgcatatctttatcatcaacatacacatgggcttcatgtaataccctctttccaggtttcacatgcatattaccaacattaaccttcttaattggtactccaccttgaatcaacttcaacatatcatctggtgttttgcaaacaataaaaatttgttgttttggactcgctttatgaataatatctattgttttttgtaatgaaaaaaaacgaattccaattccaacagaatcagctgtcattttcattacagatttttgaacttcatcatgtgaacattcatcatcagcaacaacaatcaaatttgcttcacttgctccagcccatgcattaccaacttgtccatgtacaagtcgattatcaattctcgcaagaacaatatttggttctgccataaatttctctccttttttctgtatctgtaagtgcacactttacatatcttattttatatctttgttacataatttgtcaatatgttattacaaattttgttataagaattcctatttacttcatatattatcattaaaattgtattatttgttattttcgataaaaaaatcacctattttttttgtatattcattaaaaatatatttttggtttttacctcttttcttttctttgaatatctgatatgatatatttgtcaatttgttatgacaaattattgaaatatataataaattgtcatataacatatgtacaaaaaaataaggaggaaagatatgaacaaaaaaagtccttctatgttgtcgtttattgaagatacccctaaacaaattcattacaacatagaaaatttacatgttttgacagaacaaatcatcaatttttatttacaaaaagattaccaaacaatttggattattgcgtctggatcgagtgctaatggttcacaatgtgctaagccatttttaacaaagtatttaaattgtgatgttaaaattatatctccgaatacatttatttattcggaaagtaatttaaaagacaatgattttgcttttgttgtttcgcaaagtggctgttctacaaactctattgaagcattaaagaaattaaaagaattagggtttcctgctattggattaacaggaaatattgaatctgattttaaagaatttgctgacatgattattgattatggtgtaggtattgaaacagtgggttatgtaaccaaaggtgtaacaactttagcattatttcttattttatttgctttacaagctgctataaagaaaggatatatttcaaaagaaaagtataatgaagtattcgaagaattaactgatataccttcacgacatcaaacaattcaaaatcatacttgggaattttatcataaaaataaagcagccctcacatcaatgaatgtgtgttattgttgtggttttatacaaggttatggtatagcaactgaagctgctttaaaaataggtgaaacaattcaaataccaagttttgcttatgaggcagaagaatttattcatggccctcatttacaattaacaccttattatacacttttctttatagatgatttttctttgggtagtgatagattaatacaaatttatcaagcagcccatagtgtttctgattatgtattcgctataacaaacaatcctattgttgatgatcaacatgcattacgtttaccatttgagataaaagaaccactattatctcctttatacttattaccattttttcaaatcattgcatatcaagttacaaccgacttaaataaatggaataaacatcctatgcttgctaatttcgaaaaatatgttgattccaaaactgaaactatcaaaaaggttatgccagattaatgataaaagctattattttcgatatggatggtgtcatcattgatagtgagccttattatcaaaaagttcttttacacattcttagacattttggaattcaagcaacttctaacgatttattagcattagctggtggttcttcgactcactttaatgaaattataaatccattaattcaaggaattatttctagaaaagattttgatctttatcattctcaatattattcgaaacataatattccctatatggaaattatatttccatatgttaaagatttgcttcaatggcttaaagatcatggttatcgtattgctattgcttctagttcaaaacaagatgaaattctaaatgttcttaatgtatgtcaaattagagaatactttgaaattattatgagtggtgatatgtttaaagaatcgaaaccacatcctgaaatatatgtcacttgtgtagaaaaattaaaacttaaacctcatgaatgcatggctattgaagatagtgagtatggtattactgcagcaaaaaaagcaggacttacttgtatagcaaaaattgataaacgttttggatataatcaggaaatggctgattatcatattaataatttaatagaaattataaaaatattggaggaaatgaaatgaagaaaatattatgtccaagtatgatgtgtgcgaattttgaaaatttgggaaaggaagttaaagatttagatgaggctggttttgatatctttcatcttgatgtaatggatggtgtttttgttcctaactatggtatggggcttcaagatgtagaatatatttgtaaaactgctaccaaaccatgtgatgttcatcttatggttgttaatcctggagactatgtagaaaaatttgcgaatattggagcaaagattatctacatacatcctgaaactgatgtacacgcttgtcgtacattacaaaaaattattgatgcaggatctaaagcaggaattgctattaatccaggaacttcatttgaatcagtaaaggaattattacatctttgtgattatgtaatgttgatgagtgtgaatccaggttttgctggacaaaagtatcttgattttgtaacacctaaatttaagaaatttgttgatgaagctaaaaattatggtggttataaagttatgattgatggagcttgttcaccagagaaaatcaaagagctttcagcaataggagtcagtggattcatattaggaacaagtgcattatttggaaaagacaaaagttatcaagagatttgtaaagaattaagaaaggaggaaaaatatgaatcttaatgaatctaaattatggaaagaaattcatcaacaagatgaatgtgttcgtgaatgtttaaaatacaatttacctattttaaaagaaattgctttcaacataaagcaaagaaacattaaaaatattattttcgcagctagaggcagtagtgaacatgctgcacaagtcgcaaaatatgtttttgaaatttatactgatatgtttgttaatatagctgctccttctataacgacttgttatcaaggtcatgttaattatcaaaatgctcttgttgtaggtattagtcaatctggtggtgctcaagatgtatatcaggtgatgaaaaaatgtgtagatgatggtggtatatgtgtttctattacaaatgaaccagaatgtttaatgtcgacaattggacattatcaattaaataaccattgtggtattgaaaccagtattactgctgctaaatcttatataactcaattaactattttgattgctttagcttatcaaatatctgaaaatcaggaactttttaacttactagaacaactccctgatattataaaagattcttttcaattagaaaatcaagttcaaaatgttattcctttttttagaaatagtgaacatttattaatatttggtagaggtttattatatggtttagttcaagaaagtgaattaaaaattcaagaaacaagttatttagatgctcgttgttattctgcaagtgattatcaacatggtcctattgcaacctctttatcttttgtaccaacaatattttttattgctgataaacaaacagataaaagcattattcaacttcatcaaagattaaaagaagagaaaaacatcttctcattaattatttcaaataaagataatataagtgaattaggagacctttctattaaaattcctcatcaatatgatggactttctgctgtctttgtttgtgctattatttcacaaatgtttgcttgtttattatctattgcaagaggttataatcctgatagtccaattggagtatcaaaacatacagttacaatataggaggatgatattatgaatttagtaactatgaaagattatatatatgcaacacctgcaaaagttttagaaaatgttaaaaatgctgaaatgcttgttaaacctattgttgatttatatataaaaaagaattataaaaaaataacatttgttgcttctggatctagttatactgctatccaatgtgcaagaggatttctttgtgaaaagttaagaaatgatgtcaaagtcatcaatccctttactttttctgaatatgattatcgttatgttactgatgatgaatttgtagtaattgttagtcaaactggagcaagtacaaattgtatttcagcattacaaaaattagatcaaataaaccatgaaaaatatgtattaactggtaatgttgaaagtgattgtaaagcttatgctgatactatgttagattggggttgtggtatagaaacaatgggatatgttacattaggagttgttactttaattaactatcttatgttatttgctgtatatgctgctcaagcacttcaattagaagatagtattgaatatactaaaaatcaaattattaaagctatgaataaccataaaattgtatgtcaagatagtgaaaagtttataacggagaactatcaagctttaatgcaaatggatcgtgtatatgtattaggtgctggttctaattatgggactgctttagaaggggctttaaaaattggagaaacagttaaagtgcttgctgttggttatgaacaagatgaattcttacatggacctgcattacaattatctcctcaatatacagcttttgttattgatagtggagatcaaacagcagaccatgcaaaacaagtctttaatgggttattaaaagttgtcaaaaatacttttatgataacgccaaataaagatataaatcactctcaagtactatatattcaagattcttgtgatgaaccatttacttgtttatataacttagcgttctttgaacttattgctgaaattatatcaacagatttaaattcaaaaaaatctcatccactctactatgaaatgaataaagttattgactttagaacatctgaatttagaaaaacacatagtagtgatgaggatgattaatacatcatgtatttattaatacaaaaaagaataaattatatattaactatattatttatttttctagctattttgctttatatcttatttttccctatatttagatattggggatttacaggaatgattattagttttatgactcttattttgatttttcattttcttattgataatgttataaaacatacagaagatataataatttatagaatgttatcaaaaaagcaaatagctttatgtcaaattaaaaaagttcagttctataaaacaaaaaaagacttctattttagaagtcatcatatttacggttttatttcaagccatgatatttgaaactgcttttcaaaatcttgtggttttaatatatgtagtaaaaacagacctcttctgtttcatgaggtctgcttttttgctttatattactttgatatcatatcataattatttaaatatatagaaagtaaaaaggatgatacccaacatcgccaaacgtcacttatcatcctctgtcaaaagacatgattataataactgattactctataaaactcaatacttccaaagctaaaaatgattttgatgctcttataaaattcagaaaactatattctgatctcatttcttcattttctttatcttctattgaatgcacctgtggcagtcataactggcatatgcattcttcctattctcgcttctatgattttcttggaagaaaaatcaaagtttccattcagcgtattatctgtgcttcatgcggtaaaactcatgctctgcttattgaagatatgattcctttttctacttttacattctctcaaatcatcgactgtcttgatgatcctgatttctctgtggataactttcacagatcttttctgatcaacaaatattataacgttgaacaaaattaccgttcatactgtcaaataaaccgaagaaatcatatgcttatttttcttccaacataacttttatctttttttctgttcttttcattatcatttaagtaaagataaacagaaggagatgattttgaaatgaatttgaacaaatttttatatagcgctggtgatttctatgaaacctgataccaatactatgtccactgatcacaacagtgatgtattaaaaatatttggtattgatagtaacatcattgaacattacgatatcttccatagaaaagatggtgtccatattatcttgaaacttataaacagagaacagcgttgccctgtttgccagaccagaacaactaaagttgtcaattacatagataagaaaataaaacattctgttgtttccacttcctcttgtttcattgattatcatgcccgacgttacagatgtcctgcatgcaacaagactttttatgaatccaatccttttacttttggaacggaaaggatctcgtcagctaccgtttatagtgttctgcaggatcttaaaaagccatttgaaacatttaaaagtgttggtgaaagatatcatatatccaccaatacagtcatcaacatatttgacagatatatcagtacaccaaggcttcccatgccatctgtactttcaatagatgaagtatatgttccaaccgatgacagaaacaaatatctctgcatactttttgattttgaaacaaagatgatcatcgatgtcctgccatcaagacataaaaatgtgttatcggcctattttcatagcgttcctcttgatgaaagaaaaaatgttgaatatatgtcatccgatatgtgggtatcctaccacgacatatcaaaaatattcttacccgatactatcaggacaattgacagattccacctccttatggagttttcaaaaaaatttaattcaatcagatgtgaaacaatgaaaaaatatgcacttactaaaaatgcctatcagaaagaaaaaacaaaaagaaaactgaaacctgatgaagaagcaatctatagagaagcatgtatcaactattacgcctttaaaaaattcagctggcttttctataaaactgattctgatattttaaatccaaacaacgataagaagttcaacagggtattcaaccgatatatgaatttttatgatatccatgaacatatctgttcatgtgataatggttttgaagaaatatgcaatctaaaatatgatctcgatatgttctttaaaaacagtacagtcgaaaccgcaaaagagaaccttgaaaatttaataaaggattttaaagaaaatgaccgtgatgaaatgaagaacttcgcaggtactctttcccgttggaaaaatgaaatcatttattcttttacgatcatcggtgaatcaactatcaataacgggcgcatagaaaatataaaccgaacgattaagaccatcaaaagaaatgcgaacggatataaaaactttgagcgcttaagaagacgcataatgtggtgtgtaaacaagcagggaaatataatactcagtcaaagaaaggaaaatgaatcatgaaaaaatatacagtgattgtagatgaagattatcaggcgtttaatgaaaactgcaatataacgctagatgaaattgatttaaaaatacaggccctaaacaaggagttggaagacataaagaatatagctttgaaaaactatgatatcctagataaacttttcgaactcagacatgtagatttttagacaatataaaaccatgaggtgtctcatttgagatttgcctcatggtttctcattagctctatttcaaaaatatcatgttatttcataaagcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtgtctcatttgagatttgcctcatggtttctcattagctctatttcaaaaatatcatgttatttcataaagcctctttcgataccctattcacctaaaatcattacattaattattcttgttctttctcttaattgatcccaatcaacgaaatatactcgtcctaaagtccccaataatatatttccatcacgtataataaacgtaagcgaaggactgccaaacactgatgacctaatatgagcatctgtattcaacattatccatttttcagctgggtaatttgaatcacttaaacttaatccaaattcaatatgttttggtcctggactgttatattgattttcacttgtcatcttaggtactaaacgatctaaagtattattaatatcaacttgtaaatactcgtcaccataaaaattagtatcatgcatagtttcatcaaaatataatgaacatgttgtatgtgcacttgaaactgttatcaacccatctttaatatttgatttttttacaaaatcaattaaatgctgtttaatatcgtgatatgatggtctacctataactgtctgaaggacaatatcatcatgataaatattcatactataaacctaatctttcttttaaatctttatataattgttctacccccaaacctgttaataaaggcaatccattaataaccttatctttaatagattcagatacaattgttgttgagataacagcatcataatcatcaattttattcaactcatcagctaatttagattgataaattttaacttctgtatatccattactatttaaccattcttgtacttttgcaactgcaattgtagaagttgcatgtcctgctccacatacgattaataatgttttcattcttttttcctcctattgtaccgcgggcttttttattttatttacataaattaatagtcccaacactataactccaataataactaatccaatccatccaattgattgtaacagtattgtaaataatgctacaggccataatccacagttaactgatgttactaaaccagcagtgccaacattatattctgctaatttaaatacatttgtaataactggtgctaaccaggttgacaaatataacattgtcaccatatataaactacagcctaaaatacttctcacaatattccctttaaagaaaggaaccattaatgcaatagcaaatgcataaaaagctaagtcgccaaatggtaatgttttattgcctggtaaaataattgctaataataatgatacaggtaccataattaaagtagttgtcataactgtcggatgcccaacagtaagcgctgcatccataccaatgttaacactacgaccatttaaatgcttatttgtccaagtttttgcggcctcagcaactggcattagaccttccataaacattgcaaccatttttggcataattttcataacagctgctgttgtcattcctaattgaccaattttagcaacatcataccctgccaaaatacctacacctataccaataattaatcccataataactgtatctccaaagataccaaattttttaccaattgtttctgcatctgcatcaattctattaagacctgggatatgatcaaataaccaattaacaggaattgcaaaaatcgttccgcataaagccatcatatgtgtaatagcaataccaggatacccaaagaaattgctgattttctcttgaaataagtctgcaagtaaccattgaatcataagtgctactataattcctaaaagaccaacccaaaaacttccactaattgcattagcaaccaaccccaagaacgctgggaaccaaaaattccaaatatctacatttaatgtttttgtccaaccaagcataacaaacactaaattaagtcctaatgaaattagtataatacaaatgcctaatgttgtagaaaacgcaagcggccctccaactccacaaccaatatccataatacttaatgagttaccatatttttctcccattgtttgaatagctgttcccaaatttgatgatagcaaaccaataactaaatccaaaccaatagaaccaataccaactgtaatcccagaaataattgcctttgataatttaaccccaaaaaataatgctataataattattataatcggcaggaaaactgttgatcccaaaccaataaaccattgtaatgcttcaaccatttttttaccctctcttaataaattccatttctatttaaaatacccataaattcttcttcgttttcacattgtttaagtgcattaattgcttctttattctgaaacaatgcgattaaattttgtaatatttgtacttgttcatgcggttgactcatagctaacataaatactagttcaacttttattttttcatttttatctcccatgtttaaaaactcaacaggttgattcaatgatgcaaagcagatctgtgaataattaaccttgcttgaatcagtgtgaggaatcgcaaatcctatatcattaatcaataatcccgttggatattcttcctcacgttctttaattccttctaaataatcacttttaactacaccagcttgaaacattgttttgaacattgtttcaaacaattcatcctgagtagcaaatatttgatgaaacatacataatcttttatcaaaatacataaaattccccctctattacttataaaataaatctatcattgcatcaatactactaatttttacaatctgatctatatattccttcttaataatgatttgatatatttcttgaataacatctttaaacttatcaacatgatcttcatttaaacataccattataataagacttactagattaccaccccaatcgacaggtttatctaaagttagtatagatatactagatgtaataattgttgatggatcggcatgtggcagagcaactccactatccatacacgtaactcctgctctctccctattaaagattgaatctctaaatttttcattaacatattctctattttctaattcttgaattaagttttccaaacactcttttttatttttataattcttctttatttgaattagtgttggattaataaattgacttagatatggtgcagagaaatttttcaattctctgagtacttcttctttaaatagtatatgttttttatatgcgtccataatattgatataatcttcattggtaacaactggacttactctaacgtatggaacatttatattatctaaatcaactgacgttataatcaaatctacatgagataaatccgcaagatataatttttctattctggatagttcaatgttatctttagctggcaatagtttacggactttactcaatattaattgggaggaagatattccatatggacaaacaactaatatattattagcttttgagatattaactaatgctatttggaaatgaacaagtattaatgaaacttcctcatcatttaaaataacattatatcttgattctattaatgataatgcataccagacaattgtaaataattctgtatactgctcctttatattctctaataaaggattttttattttaattccctttttcagtcttagaatcattgcaggaacatgataaatcagcgacttatataagtgcttatcttgtcttaagtcaatcttttctattttagacataacttcaataattttgtttactaagtctgcatattcattttgtcctgtttttaaactatttgttattcgatgtgcaaataattgcctacataaatactcaatatccgcatttttaaaatatagatttaaattttgttgcaacatttcaacaatgctattcgccacaacatacgtttccatatagcgtatattattaaacaagaacgtttcttcagttttaacatgataaccatatttcaacctaacaatttgtataagaagtataacaataattgatttcagataataaatagatacatcatttgttaattcgttatagtcttctaataataaatggaaaacgtaatcaatatgctgtttatcaaataagagttctaatttacttttcagatccaataatgaatcatctttatcatcttcaaaaacataatcttatatagatttttgcaaatctatttctgtacctattgatacaattccaatattagttacctttagttttgtattctgtctttcaaatacttcattaatgactcctaaatcctgatataaagatgtcttacttactaaaaaatcatttgatagattttctaaagtagtatttttgttttctaaaagaatctttcttataatagaaaaacgtcgattcactggagaatactcatctcttttattttcatcactaatttcatctatgagcttattaagattgttttttgcgtccaataatttaatgccatttcttggcgaagaatcaagatctagaccattttcttgtaaaaaactgtagagagcatttatatcactatatatggttttcgttgatactgataaccatttagcaaagaaagatgcgggcttatactcactttgttcttttaaaagttttaaaaattttatttgtcgactattcattttctcaccccataagttaactctgtttctctttccgaatatatgataacatcgtaacaacagtgagggcaattacatatacttccttattgatgtggaaaatctacataataaatcatcgtacaatttgatgattatatttttattaccgttttaaaacgaaataaaaggcataacttccacttatgttggaaatatatgcctttatgcatagtaacgatttatcattagtataaacaatatcgcctttaacaactgaatcgtcaacaaacataaatccagctacttatactttatctgccgagaaccctttcgtacctccataatatatatgaggactttgaatgcttgaacctatcattatcaccctaaccttcatactattaaaaaatttttatagttctctaataacagtttttatttctatcatagtaatcgatttaaccatctttcttgtataataaaaatgtcccttgttgtaacatttatatcactttttctttccaacctttgtacaatgtagatagaaccttaatactcttatatttctatgtggtttatccacttatcaggagagtgaatctataggatcttataacatctgtttatagctcgatagattttgatatcttcatgtcacgcaaggttacactagtaagattgctatagaaatgacaagttttctagaaaggcggtctttttatgacaaaactattttgcggtattgacgtagccaaatataaacacgtcgcaagtatctacaatctatctacaggtgaaataatacttgattcaatacattttgataataatgaccaaggttttaatacattattatcaagcttatctaaattgaataagagaaatgaaatattaattggctttgaatcaactagccactatcaccaaacattattcaattttctaacttctaagaaatataagtgttatctgatcaccccttataagacaagtaagtttagatccatttctcgcctattgacatatatgtataaaatttcaaattacttcattaaaattataacataaaaaaattacgtcatttttttcaaagaataagttatcaactaataattatagtttatttttctttattcctgtcaaatctaatattaatgaaagaaggaatgatattatggcagttgagcaggatatgtgctttagcaaatgtagattattattcatttaacctctggaaaaataaaggaatatttgttttaactcctaaagaaatagatgctttatatgatgcaataagtcatgtatgtaaatgatgtaatactggacaatattgaagagtggcataggatgatttgccattttgatataattgttaaaaaaagccaagctaaaaattattaaagaaataatcagtatatattatgaatttttttatgaaatagtaaaatttatagcgaaatatgtgtagtgtacctattatgttagtttaaaagaggtaaaatacaaagactttctatttatataatatattaagtcatgtagaatacctcattttaggcttatgatatattattggaaatttgtaaaattaataaataacgaatgataatgccatataaatttattgatatatagttcttttactcttttgtattagttatgtctttgtgtcaaataagagtatgttaatgtaaatgctttaatatagtacgtttatttttttatcatagaatagtaggcatttaccaataaatacactcagcttttcctgtatttttatctacatacgaatatatctcttcaccatcgtcgaaatatgctgtgaaaataattttagaatatgtttcagtcattgtaatttcaggagtctctccattattgaagtcatattttcctaagctcaccgtactagaagctgataatggtgtgatcaaaaatgtagatgctaaaataaaacttagagaaataattaataattttttcaatttcatatatgtcaccatccttaaatttgtagatatttttatagcattatctctcactaatattgtattctacttatttattattttcgatttatatgataaaaaacattggattaatcaatttttttgcgttgaccgaattttttctttgctgctatgttgttgaatatgaaatgttaagaaatatataaataaaatttccttattatattgaaaagcttgttttaatatgctaaaaaatacaatcttttaacctatagaaaaataaaggaatatttgtattttttatatagcgattctaaacctgtattatataattcttctcctttacctcctattgattacgtgtgtgaagctatgaaaataatgaagaggaaatagtttgtgcctggataatggaattagttcaggcgatatctattaaataattttgtgtaaactgatcctccaatggtagaatgaaattaactaccaaaggaggatttttatcatgagtaaaaaagatatagttaaatatataattgatgagtatggtgttacatcacctactgatataactaatgctttaaaagacttattaggtgaaacattacaagatatgttgaactctgaatttgatgaacatatgggatatgacaagtatgatcaaaaaacagataaaactaattatcgtaatggaacttccaaaaaaaacagttaaaacatctcaaggtgatgttgataacaaaattatcaacttatatgcccgtggtatgtctacaagagatatcagtgatactgttaaagatatttacggtgtagaagttagtgcagctatgataagtaaaataacagataaaattatccctaaagctttacaatggcaaaacaggccattagatactgtatatccaatagtctttattgactgtgttcattttaatgttaaaacagataatatggttaccaaaaaagctgcatatgttgttttaggagttaatgagaatggatataaggaaatatttggtatttggatcggcgaaaacgaaacagctaaattctggctatcagtactaactgatttaaagaatagaggagttaaggatatattgattatttgcagtgatggtctttcaggtattaaacaagcaattgaatcagcattcccaaatacagtacaacaaagatgcatagttcatctaattaaaaattcatgtaaatacttgagttataaagacagaaaagaattctgtaaagatctaagaacagtatatacagaatctacaagtgataaagcattagaagcactggataagtgtaagggtaaatggggagataaatatccgtatgcatttaagccatgggaagaaaacaggaatgaagtttgcagtatgtttaattatgttccagaactaagaaaaatcatgtatacaacgaatgcaattgaaagtttaaatagtgcatttagaaagtttactaaaataagaacagtattcccaacagatgaaagtttattttatcttgagctaaagcattgagtccaactgcatattttaattctttaaaggtagtttcaattctctatctcatcttgtatatttttttaattttttctaatggaaattcatctctatctaaatttgtggtaatacattcatagtattataactattaattcttaaaatacttataaagcttatcttcaatggcacctgatttcatacagataatgaacttaattaattcattaaaagaaagttttctttttcttgtaaaatctaaataaggattaaaaagaaaatttttttctgttcgaaaagtgctttaaatatgattctggatttatcaatacttccggaaaagttgattttttaaattattatgctaatcgaatcgatatgtaaaatagctattgacttaggttaaattttgcgagaattaatacgactggatctaactggtcctatttctttagaaattatcgattcaatatcaggtggatgttttccaccttttttaattcttggataatccctcaaaattaaattctgctccacctgcaaattttgctccattattagatgaagtcgcaacaaacttaatttgtgttgctgttgtagcttcttttaaatttacataaataggatttactccttcataaacaaaatttcctttagcaacttgtttccattcagatgaatcaactgctaaatcatcaccaacaggtccattataaacccataattcatatccttgaatatttccatttgtctcttcaccttgttgtctaggtgtataagaaaatgcttgaaatgtttcttcaccttttaaattaattacaacgttatgaggatattcttggtcaccagttcccccaccataattagtatgccaaattgaattaacatcaccgtctaataaattttgtgctggtccatcacttggtcctgatgggttatgaaaactatcagctgtcgctgtccaaccattacgattaagtgccggtacaactggagcatctttttgctctttagttgttttaataataaattcttcgctgcctgtcgctggttcaaacgttgttttagcacgtttattttcaatactagtagtttttaatttattatctactgttgaaaattccctttcaatatactcgtttccaattgttacaatgttatttgaattagttacttcaatatcagaagctgctaatgcatctaacttatttgtattcattggaacacaagataagtaagagctaaaactaatgaaccttttaaaatttttttcatttttctttcctctttatcttttcttaatgtatgtttatatttttagttaaactactggtgatttagttcatattaaaaatacattagatattctagcatattatttattttaattatttctgtaaattagtaatcattttgtataaaaatggctataaatatgttgcaggcttaaaaatatgtaaatttgctgtattaaaaaggataaaatttatgttaattaaataaaatatctgtctggtttgacgttttgtcaaataatagtttgtaagtggcagatttgtaggtttccaaacgaattgaatttccttatatccagtggacttagtctttgttaaatgttaacatggtttattttaaagtctaatttgctattttaaaataattttatcaaagtaaatatttagtaaaggttatataaaagaaaattaaggaaaaaattacttagtattaacatactttgttgatgattttgttatattacctttgtaatactaggaggacgaaaaaatgacgaaggaaaaatcaaataaagtaattaaagccacaatggcaaccttggtgacaactcttgttgtaggtagtaatagtgctatttcattacaagcagttaataatgataatagtgacacagctatcttaaatgaaaatagtgttacatcaccaattattattagtgaaatagttgctgatagccaccagagtgatatgacaacaactagtggtagagatgcatttgagtattttgaattgtataatactagtaatcaaagtattaatttagatgattatcaagtattatatgataatggtagtactattagtgagtggaatttacctgctaatacaattttaccagctaatgaagctttgattgtttggattcaaaatgaagaaagtaaagatttagatttagctttgtttagagaatattataatttgtcagctgatgaaggacaaattgttaaaactgaaaatattgttagtggtttttctaatagtggtcaaagagaactgcgagttacagtaaaaaatactaaacaaattttaagttcagttatttataatgatgaagatgttaaagtacaaacaaaaaaaggaattaactttatttacaattctggtagaattcaagaaagtacttttagttatgacttggatcctacaccaggtagtttgattgaacaacaaaaattagaaagtaagtatcaatttgtaacagtaagcgatggaattgttaccattaatactgttcaagaaatcaatgccggcgaagctttggttgtaaaagctacgactaatttaccaggagttattttaaaagcaactttaaaggtaaatgataaagaatatgatatgacatatgatagtgacggtaattatgtttatagtgtccctgctagcgaaattagtaatgaggatcttttaaatattactgctacttttaatgatggtattaatgaaattactagtgcaactcaaacagttactgttaatgaaggggcggttgaatttgcttcaccattgttgattagtgaattatcaccaaatagtactaatgtttctggtagtgatgcgtatgaatatttacagatttttaatgttagtgaccaaagtgtagctgtaaataattaccagcttgtttatgttaatggtaataaagaaacagtttggaaattagatgatgatattgtcttagatgctaaagaagtattaacagtttgggttgttaatgagacagtagaacaaactggcttaacagttgcagattttaataataattatggtactaattttgtcgctggtgataattttacaactattcatagtgatggaatgagcaatagtggtactcgtggatttaaaattatcactaatactaatcaagaattaacatcggttaattatactgctagtgattctagtaatggtaaaatcgacacagatgaagctatttattataattacacttcaaattccggagtgccagtttatgataatgaagtaacattaggaaaattaaatagtcaacaattaattacggggcgctatataacaccagcgattgtagaaaaccctgaagtagaagttggggcagatagttttgtaagtgcaaatagcaatttcactgtcagtgtagaaaatactaatcttacaaacacaattattgatgctaagttaaatttatatcaggatggaaatgtagtagccagctatgatttattatatactgatgggattttaaaggtagatgtacctgctcaagatttagctgcttattcaaatttaacatatgatgttactattactgatggttttaataaggtgacttctgttaagaaaactgtagtaatcgaacagccaggaatgattgatcaaagtaaggttgcccccttggttattagtgaaattatgcctgatagttctaatgtcggtggcagtgatggttatgaattcattgaaatttataataattcaaatttggatattaatttaaaagattataaattgtattataattatcctgatcaaggtgtagatggtgatgttatctggtatgaaactaatgaggataaaattatcaaatcacatgatacattagttttttggattaaaaatggtactaatgatgatttacaaattagtgattttaacaataagtttaatactaatctagatagtgatcatttaatttcgatttataatgctggaatggcaaatggttcggctcgtgggttaaaaataacttctaatattaaagatgttttagattatgttttatataatatggatggtgttgatgatactgcagctgataaatcaattgtatatcaaaatagatatgatggttcaacttttactagtacgctaatcgataatagcgctgaaccaacaccaggaacagtaactgaaaaacctatgtatgaggctgttttaccagaaactgtttctttgatagaatacaaagatcaaacaccagctacttttaatgaagctaacgatttaactttctcgcttgatgctaaatctaacgatacaacaattaagagtgtttacttgtatttaaaagataataatagcgaagattttgaagtttataatttattacgtaattctggtgataatttttcaaaaacattaccagcagtagatttatataataaatcatcatatacatattattttgctattagcgatggttatcaacaaataacaacaccagttagcacagttaataatgaaaaaccagtttctactggcgatcaaattaatattagcgaaggtgcgattattaaccaaactgaacaaattattggtaccgctaataatttgataattgatgatcaggatgtaactgataaagcagtcaaatcaattaacggaaacgcacgaattgtttttgatactactcaaacagatgttttctttaaaaatgcagttgcaattggaaatgatgtaattggcgttttcaatgaaggtacttatagtgactggcggacatatgcttatgatattaatgctagctgttttgacagtgattcaaaaacaattactattgctttccatgctggtaataaagctaatgctttagaacacaatgttgaaaataacgatgactttactataaagaatattagattaacattaccagatggtacaactttaagagctggtcagtatagtgctgtttatggtctaggagcagttgaacatactgaagataactggaaaccagatagtccagttgaagttaatgatattacccctgaaaaagaaattagtatgggtgatggtacaagcaaagttgaaattttatatgctactttcacattagatgatcaaaactttaatgctttacgttatgatcttgatacaactgcgttagaagatggtactcatagtgtaacaagtggtagcaagacggtatcatttgttagtgataataccgcaccagttattgaaactaatatggttgaaggtcaaatttatcataatggaactattgaaggtagtgcccaagatgctatttgtgatacgagtactttaattgctgctcttgatggggaaggaattgaattgccttatgatttccgttcattagaaatggagccaggtaatcatcaattagtattaacagcttcagatatgattggaaatgttactagtaaggtaataaattttgtaacaccagaagaaaatgcagcaattaatggggaaataacaccagtaagtgggacaactgttaatggtgatccaacatttaaagttactgtaagtgatagtactgatgatttaatgcaggttgctttcaaacgtggtgaacgttatctattaggtgatgctaatattacttcatctagtggtattagtcagattgccggtaataatactcaggatttcagtggtgattctggtgatggattcccttatcaacagtttgatgttaaagtaactggtgatataagtgatgatgcaactgttaagattgattggaaaggtaaatctaataatcaaaagacttttatgtatgcttataactatgcaactaatacttttgataaattagatacggttatggaaattgatggtgaaaccatgaaattaaccggtgaagtaatattaaaagatcacttacttgatcaaacaatcaaaattatggttcaaaatggtgaaggatatacccctgatcaatatagagaagattttactggtgcaatgtctaatccagcagatacaccaagagaaaactatgattttacatttgctgttgaaagtgatactcaatattataatgaagactttgatggcaatccagatcaagatgttgatggaaactatcaatatcaattagatattcataattggttattagctaatcgtgaacggatgaatattcagtatttattccatgatggtgatattattgatgatgaagatcaagtgcaagaatggatcaatgctgacaatgcttataaaatgcttgatgatgctaatatgccttatggtgttttagctggtaaccatgacgttggtcatttaagtggtgattatacttctttctccaaatactttggtgaagatcgttataatcaaaacccatggtatggtgaaagttatcaagacaatcgtggacattatgatttaattactgttgatggcattgactttatcatggtatatatggggtggggtattggtaatcaagaaattcaatggatgaatgatgttttagctcagtatccagaaagaaaagcaattttgaatttccatgaatacctattagctagtggtggtttaggtgaagaaccacaaagaatttataatgaagtcgtagctgttaatcctaatgtttgtatggttttatctggtcattatcataatgctcaaacagtagtatcgcagtttgatgataatcatgatggtgttaatgatcgtaatgtttatcaaatgttatttgattatcaaggtttagctcaaggtggtatgggttatatgcgtttgatgcattttgataatacaaatggacaaataattattagaacatattcaccttcattagatgattataatgctaaagatgaaagtaatattggtgatgtagctgatattaatggtgaagaagaatttgtaattaattatagcgatttaggaattacaccagttcaaaaacaaattgaaacaacaaatttagatgttaatatttatactgatgatacttttggtacagttaatgatgtaagaagtaatcaagaaatcagctatacattagaaaatgctcctcatggattatttggttggtatgttgaaattagtgatactaatggtggtttaacaagatcaaatgttaattatgttaatattgataaacaaaatattaaaccaacaatagtattacctgatgatgaatttaataagattgctgtaggaacagattttgatccattgaaagatgttaaagcttttgacagtcaaggcaatgatttgactagtcagattgttgtattaggtagtgtcgatgttgataaagctggtagatacgaattgacatatcaagtaactgattgctttaacaatgttgctattgtaactagagtagtagaagttgttgaaaatgatgacgatcaagatatcaatgttcaaccaggaaacgatagtagtgtaaatggaaataatagtactactagttcatctgccaatgcaccacttaccggtgatcttgctaatagtaattatttaacattagcagttgtaagcttaatgacttttataataatgatcaaaaaatatttaaaaaatctaaaaaatattcataaataatgaattaaattacatagaaatagagagtgtaatataaactgtgtaagtcagtagcgtacggattgacttcacagtttttattgtgaaacaaaaaccacgtgctattgaagtgaacccagaaaattggaaactttaaaaacctattgtaattgacttatttaactgtcatgaacctttcttctttcctaataattctgatggttttgattcttttatcaaagctgttaaaaaatttaaatcacctagacatattgtaggcttagaagccatcggtcattacggtgacaaccttatcagctttctaatcaaacaagattatgaggttgctttaattaatccattaaccactgatgccaagcgcaagtctaaaatccgcaagactaagaatgataaaaaagatacttttcttatctgttcagtactctttgacagagactatactaaagtcactcagcataaactcgatatgaaacaggttcgagaattaacccgttatcactcttcaattactgaagatatcaatcaaaagaaaaaccgtcttcaaaagtgtatcgatatcgttatacccgagtttaattcatggtttaaaaccaagtattccaaaacttatatggctgttttaaaagaatttggaagttcttataatttagccaaagctaatcttactcatctcaaaaacgttctaaaccctaaaaacaaggggtatcatgtagagatagatgcatcatctcttcgtgataatgcaaagaaatctattggcgaaaataacgaagttattgctcttgaaattaagatgcttattgaaaatattgaactcttaaccagtcagcttaaaactatagacaaaaaaatagaagaattagatgctaaactagattctcttatcttctcgattcccggcattgggatttatacgggaatgtctattttaagcgagattggtgatatccataacttcagctctgctgtcaaagtcatgggatttgcaggtgtagaccccggtacttatcagtccggtgaatacagcgctcctcaaacagcattgtctaaacgtggttcgcgctacctaagaaaaaatctatatcagtgcattcttacagtatgcaaatacaatctcactttcaataagtattataaactaaaacggtcacaaggtaaatcccatagatgcgcccagggccattcagtacgaaaacttataagagtaatctataaattattgtctgaaaacataccatttgatgaaagacagctgatttaaaaatatttaacttaatatttttaaaattctgcataaagcagtagttttcagtgtacacaaaattcacttttcaaagaactaaaaaatatttcagctaattatcaaaaatcacttgatttatatatagttagctttcctgtaaaaattctacttctccattcagtatattttttgtattaggtatctgcaaccacgctctttcaagttcatcattgcaatattctctcactttatctggcaggctttcccagatttctttaaattgaagtgattgagataatctccactcagctacatcttctcctccgtattgaccatactgatattgatcgcatgcatcaaaatgtttgtgaaatgcaatattttcaacacaattaactatcgcttcttttactttaatgttttgtaattcttcatttgataactgacctaaaatatgatatggaatatttacattcatagtggttaaacgtataattatttcttcgattgaaaaattggcattacttgaaaattcattcagatagtcgagtattttattcccctcgttatatttatcatttagaaacaggtataagttatcgtctaagtcattattgccacttaacttaaaactgtgaaaacttatatcagtatatggttcagcatatagatccccaaatctgtcacctccaggataattaataatcaattccgtttgatttgttagatgaataatatctcgatgatcataataaaaatcgtttctttcatcaatgttttccaactaaactcattttcaggaaattcaattttaatgtatgatattacatcgtgtatttttagttgttttgttttttcgataagattttcaattttagttttgattaatttattttccatattttttctccttgttataatcctaaatcataatcattttctaatttctcatatccgacaatactttcattagaatatgtaatacgattgatatcaattatagtagcttctttattcagctgttcttctatattttttttcattagattaaaattttcttttgctaaatttcttttttcttgtgaggtattttatatattttcaactccttcaataacgattgcatttctagacatattcaatgcagccacggctaaattactgcttccagcaaactgatcaagaataatttcatatggaagcgatatataaccgattatttcctctagcaactcgacaggtttttcagcctgatgcactctcttagttatactttttggttgatagttaaactgcgaaggaagcatacctgatgttccgctcatgtaatgaacaattaaattatttaaaattgaaatcagcatattcatatttaaattcattaataatgaataatgaaatagatgaagaacaactacaggtaatgcataaaatattgaataaggaagtaatagccaaggaggaaaataacagactttataatgtaaaggtagcagcattttctttcttaagaaaagttgacgattatgattttaattttcagccaggcataaaagaagaaaaaataagatcgattattgaatcggatttttatgaaaacgcaacaaatgttgtttttataggtaatccaggtacggggaaaacgcacttagcaatagcaattgcatatacagtagccattagacgtaatagtgtatattttattaaatttaataaattaatcaatattctaagacaggcaaatttcaagagttataacttcgttgttcaccaatggatttctttgcattggcacgaagagatgatgtgtctgtatccccatggtttccactgcttttaggctttagaagatgagtgagaatggcaccggctaaattataagaacttccaaattcttttaaaacagccgtataagctttggaatatttggttctaaaccaagtattggactcaggaataacgatatcaatacatttttgaagttaccttttcttttgattgatatcttcagtaacagaagcatgatgacgagttaattcacgagcttgtttcatatcgagcttacgctgagcgactctagtataatctctatcaaagaatactgaacaaataagaaaagtctcttttttatcattgttagtctttcttattttgcttttgcgcttggcatcagttatttatcaacttgaaaaatttggtcgctcgcatatcaaagcatcttaggttcttttctataaatatcttctttttgagcacatgtatagatgctctatttgtcatacaattttaaaggttcaaatatatctgaaatgcaattatgtgattcattcaataattagcatttttagactttacttttaatggttattgaaactggaataaacattaaatatgtttgtatcccagctacccttatcgcattagactgttctcgaaaagtgggctgtcacgattctttgaagagattgattcttatcaacaaatatattcggaaattcagcaatagtatcaaaaacaagagaattcttaagcaatcattagtttgcgtataactggagagagtgcggctattcaaataaaaaattatattgagtcacattcgtatttagaaaatacggatataattctattagtgatttctgatcatgaatacttgctaagaaaagtaaatcaaatacaaaaaaacaaaggattgtgtgtgaggtagggacttataatcaagaattatatggtataccatacattccaatttcaaaactatttgatatttcatcagataaactagatattttgttatctttagaaactgtagaatctgtcatgtcagtaaattatgatgcgatatatgcttacttggaagaacagttggaaggttttgaccttcagttattaaagaaaattttgccaaagaaaagagaataaatcaataagaaatgaaacaagcctttatataatgatttgaaagaaaatttacaactgtttgaaaaagaattttgtataaaatttgatgatgacgagttagctaatataatccaaattaaaaaatgttaaatcattacttttttattaaaattagtgtatgaagttacagtaattggctaaaagaactctttaattataaaaatgaaataaaagatttgaataatgatgttggcttatgcatctttttaatcgtttttcatttatactagtttattattctaaattctgagctaaactaatagtagcagattataatgatattggaggtataagatatgaatgatcaaaaaaaaattcaagtattacaagatgttattcgaattccatcagtaaacgggaaagaagcagaagtagcatcctatctttctaaactatttatagattacagtattgaaagtgaaagagtgccttattgtccaggacgagataacttggttgtaactatttctacagggcacggcaaagtcttagggctttctgggcatatggatgttgtgtctgctggaaatgaaagcatgtggaattatccaccttttgaggcgcatattgaaggtaatcgtctctatggacgcggatcgacagatatgaaggccggattaatggcgatggtcattgctatgattgaattaaaagaagaaggatgtccatttaatgggacaatcaaattgttggcgactgttggggaagaggttggagaactaggagctgaacaattgacaaaagaaggttatacagatgatttggatgcacttattattggggaacctactggatatgttttaggctatgctcataaaggatctattaactatacggtagtgtctaatggtaaagaagcacatagttcaatgccacaggagggatataatgctattagatgtttaaatgattgcattatggtattcaatcaaaaaatggacaagatatcaaacgattatatcaatgaagaattgggaaaaacaatacataatgtcacaattattcacggtggaacccaaataaatagtattccaaataaggctattgcacaaggaaatatacggactataccagaatttgataatggtaaagtgattgctctattaaaggaaacagttgcacaattaaatcaagataatttatttccattggagttaactattgattacaacaaaattcccgttgaagccaacaaaaactccacattgattcaagctattcaaaaacagtttgatacaccattgccagttttaggaggccctgctactacagatgctgcagagtttataaagtcacagaaacaatttgatatagtggtttttggacctggtgttactacagttcctcaccaaatcaatgaatatgtggaaattagtaattattttgaacaaattgacatctataaaaagataattactacctacttaagtgatgaataattgatgaactttatagagaaaaatagtaattagattttttcgctgattaggtattgtacagtgtatgaagcactggtactatgtcaagatttcggacaatttaaatacaagaatttagtaagtctaatctaatattttatattttttctcaaattggtccggcaacatatattcacaatgcgaacgtattctcattgtgtttaaaaatttttccaactattcaaatattagttttcataaccctggattttaaatctgtttatccactcacgttttattgatgcatgaaatgtttctatacatgcattatttcgcaggtagcttttttgaatagctttttatcatattttctgtcaattctttatatatgagagatagagttggataaaatacactaaattggacagtttttaagaaaattattatatgaaaaaaacaagaaatgaggtaatctgaaatggtaatcgacaggattgtgagaaaattaagcaagaacttacataatttataagtatcacactagagatggaatttagtaaagaaaaaactctgattacacatagtaatacttttgctcgttttctcggatataatgtcagagtacgctgtgaccagcagattaaaccaaaagaaaaattcaaaacctattctatgaacaacaaggtagaattgagtatttcattcaaagataagatagagaaatttctcaacaaatggaattataaagcagagatcagacaatgggaaattagagcctatacaccgatcacaattgcttaacagaacagatttggaaatagtgactatctataatgcagaattaagagatatctgtaattactatgaattggcaagcaattttaacaagctaatctatctcaattgtcttgtggaatatagctgtttgaaaacactagcatgaaagcaccattccaaaatttttaaaattagtactatgtataaagactgtgcaggtaaacttctaaaagtattttggaaacaaacgccctacgccagaagaatacatttacaagatcactaaaaaggcaaaaataaaattataaagaagtgtattgacaatatttcttaaaaatgacacttgcattattgtaattgttatgctctgtatagaatgacgatttaggtgttgcgtgatttctagtaatcgttgcttgattttaataagcaaatttcctaaaataatagcataaataaaggaggttttgctatggaaatcaaactaaaaaataagggatatatcttttttgtgctttcctttgctctgtttggcttagctggaatgtttcttgttcctgttgtaatattaattataaaaatatcaaaacgttatccaaaagtttttacatggattactattgttgccttttctttgatgtgtatatatctgttgatagttgagcaggaatggaatttgagttttttgttaatgtgtatagctgtcgccattggaaatgttttagatactaaaaacagataatggcggaacatggaaatttcaaaaataataaaagaggcaagaataaaaaaggaatgactcaacaacaattagcagactctgtgtatgttaccagacagactatttcaaaatgggagttagagaaaagtatatctgatgaagcatcgctagatttattatatcaatgtttggaaattaacaatgaggagaaaacggtattacagaaactcgttcataataagtaaactatatttttgattgttgttaaagcagaaattaaatttcttaaaagaataagaggtggttctatggataagcagtcatgggtattatgtccattttgtagtaataagatacggacaagaatacgagaagataggaactggtaaatttccccttgttctgtccgaagtgaaaaaaggaaactttaatcaatataaagcagggaaaagtaattattatcaaagcgctaattgctaagacgcagagccgataatttgtaggctattgtaacttatagattgttggcttttatttgttttctgcaaagcagatcaacaaataagcccttaagaaatgcaactaaaaagtattttgttcatccctcttttccgttctgccctcgtgtagttgcacatattgttgttaaaggttattgtctttttccactgcacgtctgctagaggaaaaagtgatattcccttaattgtgaaagtataataattgtttttgaattgtctgctgcataaaagaggagttaactatataaaattcaagtagtttttatgaaaaagtttgaaaatgtaaaacaattagattttatagttagttgaaactagatttttgaaaatgtgaatattggattaaatacaggcatgctgaaaagaacttttaaaattgaatttttaaaaagttgccctatctcaataaggcagggtcaaatgattgacctgtttctagcagatgataaatgatgctaagtagctttcttatgcagtaaccttgagtactgcggtgtccttttcttcggaaaatctttaattggtagtattgagtgaatacagggattattattgatgacaggcagtatgatttgatacaacgtttttctaagatatttaaaacccttcttggttatggctgtgtactgtgcattaaactgactcgattcatagtgatatagggttatacctgcagatttaataatttgagaaggcttaaaataaccggttttgaactttttcttttatttatcaatgtatattatttaaataccggagatattaaataattaaataatataagttagaattcatctaattcggattgcatgtaaattattgagttataaaaatagaaaagaattttgtaaagatctaagagcagtctacaagtgataaataattagaagcgctagacaagggcaaaagtaggcaaagaaaaatcttcctgttactacacaagaaaagcagcaaataaagaagatagggtattacgataaaatcaagtataaatcataaacgtgtcaaaaacgaaatttcataacatcagaatgtaatcaaaaattgccaactgatatatcagaattttatatagcagcaggtaaactatatctatcatctattttagatctgcataatagaaagatattgtctgatatctcagcttcgccaagctttgtccaaattacaaatatgctggatgaggcattttcaaagtatggtaatcttgaagtgatgattatacattcaaatcaaagatggcagtatcagatgtagaactacaaaaagaagttaaatgataaaagaataaagcagtcgacgtcaagaaaaggcaactgtttagatagctcgccaataacatatttttgaaacattaggtgatttaaagatcgcgatggaagaatatgtcgaatattataatacaaagagaatcacaacaaaattaaaaggattgattcctgtacaatacaggaatcaatccttattaactatctaaaaacaagttaagttagtgtccaacaattagagttcgcttcaatcacgccgtgcaccgctttttagtaattagctgcggttgctacaaaggaatgattatgatagctgaagaaaatataaaattaaaaatggatatttcatcagtgattcataaaaagtgtgtaatatattttatgaagcggttatggataactgttgtgtaataaataaaggaggaaaaattatgatgggaatttgaaaaaaacttgtgttctgaatatggattgttgtttgtactcaggcgtaaaagaattttgttcaatagaagttagtttaagatttactacgcgagattccgttttcaaagaaaaaagtatttgaagaggttaagatgtgtaatattactatttttattccttgttaacatgttagaatagaggggttcgtgctcctgcgaacttatttatctagttgagattttagggaaagaaatacctcttatgtcactaaaatagaagtatgagagagatgtaggtattttgcaccattgaaaggtaatgattttgatatttccgttatttattgctttcgataggaatatacagaattttttaagtgtgattttcttctgagaggatctttattcattttatagtattataaaggaagtatgttaattgcgctaatgtgggaatacttattttgtggagtgaaaaatagagggggcgtaaaaagatgaaaaaaaatgctatagcatatattacaagaaagagaaatagaactttaataatttttatcatattaactatagttctttcttgcttgtattcttgtttaacaataatgaaatcaagcaatgaaatagaaaaggctttatatgaaagttctaattcttcaatatcaataacaaaaaaagatggtaaatattttaatgttaatcaatttaaagatattgaaaaattaaaagaaattgaagaaaaaataattcaatatgatggattagcaaaactaaaagatgctaaagtagttagcggagaacaaagaataaatagagaagatttatctgacgagtttaagaatgttgtttcactcgaagctacaaataatactaaaagaaatattttatttagtagtggagtatttacaattaaagaaggtaaaaatatagaagaaaatgataagaattcaattattgttcatgaagaatttgctaaacaaaacaatctaaaattaggtgatgaagttgatcttgaattactagatattgaaaaaagtggaaaaataaaaagtcataaatttaaaattatagggatcttttctggtaaaaaacaggaaacatatacaggattatcttctgattttagtgaaaatatggtgtttgtagattattcaacaagccaagagatattaaataaatcagaaaataataaaatcgcaaataaaattttaatgtattctggtagtgcagaatctacagacttagccttaaacaaattgaaagagcttaaaattgatgagtcaaagtattttgttgaaaaagattctaatgcgtttgaagagtctttagagtcagtgagtggaataaaacatataataaaaataatgacttattctattatgttaggtgggatggttgttctttcattaatcttgattctatggttaagagaaagaatttatgaaataggtatatttttatctattggaacatctaagatacaaattataatgcaatttatattcgagttaatattcatatcgataccaagtataatatcttccttatttttaggaaatgtattactaaaagtaattgtagatggattcattaactcagaggactcaataatttccggtggaagtttaataaataatagtagttttatgttaaatataacaacacttggacaaagttatttaatattaataagtattattgttttatcagttgtatttgcttcttcattaatattaatcaagaagcctaaagaaatattatcaaaaataagttaggagaaaataatggatatattagaaataaagaatgtagcatatagttatgcaaattctaaagaaaaagttttgtcaggagtaaatcaaaaatttgaacttgggaagttttatgcgatagtaggaaagtcaggaacaggaaaatctacacttctctccttacttgctggacttgataaacctcaaacaggaaaaatattgtttaagaatgaagatatacaaaagaaaggatatggtaatcatagaaaaaataatatatctttagtatttcaaaactataatttaatagattatttatcaccaattgaaaatattagattagtaaataaatcagcagatgaaagtatcttgtttgaactaggtttagataaaaaacaaataaaaagaaatgttatgaaattatctggtggacagcaacaaagagtagctattgctagagcattggtatcagatgctccaataatactagctgatgagcctactggtaatctagacagtgttactgctggagaaataattaatatattaaagacattagctaaagatagaaataaatgtgtaatagttgtaacacatagtaaggaagtagcagattctgcggatatcattttagaactaagtggtaaaaagttgaaaaaagtaaataaaatgaatttggaggttgaataatgataaaaaatgcatttgcttatgtaactagaaaaagcttaaaatcattaattattatattagttattttatctatgtcaactttaagtctcattagtttatctattaaagatgctacggacagagcttcaaaagaaacatttgctaatataacaaatagtttttctatggagataaatagacaagtaaatccaggaacacctagaggtgggggaaatgtaaaaggtgaagatattaaaaagatatctcaaacagatagtatagactcctatgtaaaaagaataaacagtgttgcagatttagttgattatgatattattgaaactcaagagactcttgcgaatcaatcacctgaaagagcgaagaattttaaaagaacagttatgataactggggttaacgattcatcaaaagaaacaaaatttgtatcagaagcatataaattagtagaaggaaagcatttagaaaatgaagataaaaataaaatcttaatgcataaagatttagctgaaaaaaataatcttaaagttggagataagataaaaataaaatctaatttgtttgatgctgataatgagaaaggtgcagatgaaacagtagaagtagaaattaaaggtctattcgatgggcataatagcggtggagtaagtgcagcacaagaactatacgaaaatacattaatcactgatgttcatacagctgctaaagtttatggtaatacagaagatacagctgtataccaagatgcaacattctttgtaaaaggtgataagaatcttgatagtgtaataaaagatcttgggaaattagatataaattggagagaatataatttgattaaaagttcatcaaattaccctgcattacaacaatctatatcaggtatctactcaatttcaaataaattatttgttggctcattaatatttgcaggagttgtagtttcattattattattcttatggatgaatgctagaaagaaagaaatagcagtattactatcattaggtatatcaaaattagaaatttttggtcaattcctaattgagatggtatttatatcaatccccgcattcgttggttcttattttttagctcaatatacagctgataagcttgggaataatatattgaataaggttactggtgatatagctaaacaaatagctagacaatctgcatctagccaattaggtggtggggcagaagctgaaggatttaacaagacattatcaagtttagatataaatgtattacctaaattcataatttatgtagttatatttatgagtttagtgcttcttgtatcattgattatttcttcattcaatatattaagaagggatccaaaagaattattaattgacaataattaaaattttcggtgctttctagcaccgaaagttttttgacttttaaatatcaaataatatgctgtataatataagtgtataggcttaagtggaggtatatatgaaaatattaactgttgaagatgataatatgataagagagggaataagtgaatatctttcagaatttggatatactgttattcaagctaaagatggaagagaagccttgtcaaaatttaatagcaatataaatttggttatcttagacattcagataccttttataaatggtttagaagtgttgaaagaaattagaaagaaaagcaatttaccaattctaatcttgactgcatttagtgatgaagaatataaaattgacgcatttactaatttagtagacgggtatgtagaaaagccattttcattgccagtattaaaggctagaatagactctttaattaagaagaattatggacatttagagaagtttgaatataaggagctatcagttaattttaatagctatacagctaaaataaatggtgaagaaatagatgtaaatgcaaaagaactagaagtattaaaatgtttattggataataatggacaagtgttaacaagaatgcaaattattgattatgtatggaaagatagcgaagaaattccttatgatcgagtaatagatgtatatataaaagaacttagaaaaaaattacaattagactgtataactactataagaaatgtaggatataaattggagagaaaatgaaaaaattaaagatatttcccaaaatgttcatacaaatattttctgttcttggaataataattatattagttcattcattagttttttttatttttcctaaaacatatttggaaaccagaaaagaagagattcataataaggcaaatgaaatttccagtaatatgaatggaaaagaaataaaatatatagaacaaacgctggatctttattctaagagtagtgaaataaaggcatttataaaagaaaaaaataataataatgaattacaaatcaaagataatataaattttaatttagaaagcaatagtaattctttgataattgaagaaagagaaataaagcttaatgatggtaaaaaaacacatctacaatttgtttctacagctgatatgcaaaaagatgcgaaagatttaagccttaaatttttaccatattctttattaatatcaattttattttctgctattatttctttaatttatgcaaaattaataaaaaataatatacaagaaataaaaattgttactgataaaatgatgaaacttgataaaaaaatgcgtttaaaagttagctctaatgatgaagttggagaattaaaacaacaaattaatgatttgtattctactttattaagaacaattgacgatttggaatttaaaaataaagaaattttaaaattagaaaagttaaaatatgacttttttaaaggtgcatcccatgaacttaaaactcctcttgctagtcttaaaataatactggaaaacatgaaatataatattggaaaatataaagaaagagatatttatattaacgaatgcattgaaatcgttgatagtttaacaaaaaatatttctcaaatattatcagttcattctatagaaaatttgaataatgatgaagaatacttgaaaataaatgatacattagaagatgtattaaaaaagtatgaaatattagcaaatcaaaagaaaataactgttaataattatatattagacgagaatgtctatataggaaaaacagctttaaaaattattctatctaatttgattagcaatgcaataaaatatactgacgtaaatggaattattaatattggattagataaaggctggttgtatattgaaaattcatatagagataataaagtttctgatataactaaattatttgaagtcaaatttgatttgaataaggaaagtagtaatggtttaggattatatattgtaagcaatcttttgaataattataatataaaatataaagctctacaaaataaagatttttttgtgtttaaaataaaaatatcttaataaaaattgtgaagtcaatccatatgttactgatttaaacagatatattgtactttttaatcgagattgtaaaataatttgtgtaaaacaccccttcatcggtagagtggtgtcatctaccaaagaaggggtgtttgttataggtaaaaaggatattataaaatatattattggtggtgtgaaacgtttctatatggcaaaagtagaaaccattatacaaaaggtgtaggcctatacagtcttattatttctaaaaacaacatactgctttctcatcggaatatcaaaagtaatacaggaagttccactatgagaacagacggtattccatatcgctgtttcttctagcggacgtgcagtgaaaaaaatacgataacctttaacaataatatgtgcaactatgcgaaagatagacgaattttagtgtataaaaaaattagatggatgtatacaacctgtatgaatttttaaaaggaatatagtgtaggactgattacgtattaactgtctagagctatattcctttttctaattaaagcattagataattattaatagatcaaatgtagttcgtttgattaatttaatgataactatttgctaataactattagtcaatgttttttagtacaaaaaatatttatgaattaggagaaaaaagtgattaagaaaaaaatatgtgactatttgtatctagtggcaggtatattattttttatcagtggatttatttaccacaattcaacattctatatcttaggggtatattttgttactatatgtattgtggagaaaaataatgacgataaaaataatttagatagagtatatttaataagaaatatactctataggacagtatcagataggacagtatcagcggaaaagtaaagattatgagaagattgagacaacttatatgatagtctaatttgataaaatctataagtaaaaatatagatcgagtgtataagttatgacaaataaaacgccaagagtgaaagaaactggaggtagagttaaaagtatattaatcatctggagatagagtatgtgtcaaagaagaaaggatagcggtgagagcggtgaaatttgaatataaacttgaagaaacatacaggagtagcataggagcggtgttcatgatagatatgtctctcagtaatattttatcaaaaattgatagaaagaacgtatatgactatatcgtttacagcgatgagatgacatttatgatagatggtattattgagatggaaagttattggtatgacatagagctgatttttaaattttatggagagtattcattttttagaggaaaagtaataagtggtagtattaaggaaaatggttgtatagcagtaatcaagaatacatcggtggtaaaaaaagatctcaaggtactaatgaaaatgggtaggaatgatatgaaaaaagcatatatagagctaaagaataagatgttaaatagttttgaagatatttgggaatttctgaataaattgaaaatattctacttgaaaacgatccggtttaatagaagtatactgttgttttgttaatgagagaaagggcaaggagattatactctgtcaaaatttcggacaaagatatcctaattttttaatatttcgttgaattctttttcataatttaatggtgattggtaatcacaatgttcatgaattcttagagtgttataaaaactattaatatattcaaatactaatctagatacatgattatagtcacatatcttttgcccatttaaacatttccttttaattaatgaacgtaatgaacggaaggatttggtagaagcattatcctaaggtgttaccttgtgagaatagcttataatcatattgatgcaagaataaaaagtgtagtttgagggaaatgtagagcggtttattaatattgataaatagagaagtacatggcaggccataaaaatgtcttaaagattggtgatattatataatatgtgaaatgggctagacgtatatcctataaatgacgactgtggttttccccctatgtgtatattttaatagtgaaaatatgtaggttgatacaggatatactccacacgccaattatattagttaaatataaaaccttaatttgtcagttaaaagtaaataattaatgtttaagtgtgtagttcaaaacaattacataaaattcaaaagatataggcaaagttacttacttctcttatacacattcctattttatatattatgtttgtgtatctattgccaaattgtaatcttgcatgttttacatattttgctgctgttattatcattgttttaatgtctgttgatagtcgctttcttgccaccgtatgactcttatttcttttttatgtatcattataggctgaattgtccaatattcgtaaagtattatatgctctcatagttaaatgaagtataaaatgtttgttgcgaattttccgcttttatatgtaatattttcaacttttatattcttaataaaatgcttctctaaaataaatgatgaaaatattttatcgtattcaccagatgagtgcattgtataatagaaaaatgtttagattatttctcatataatccaaatatttgtatttttcatcacgtatacaggtattattaaatattttgctaaaagtgataaaacatgcataaaaggctattgaacatacatttttataatgatatgattgttgtagaagtgaatgcagtgttaggtttttataaaagaatatgataattttatttaaaccaaatacattatgtaaggagggatgtaagcgctaactttaaatatttgtattttaaaaggaaaaacaaaaatcaagaaaggagttaaattagtatttaaataacgcataaaacactagtgaatgattaatgttgaaatgttaatgggtattacttatagttttgggactcgctctaatagacattcacaaacacagtagagttactattctactaaattataatgatttactaatatcgtattattgataaaacaactgataataattatcataaattaaacctttagataaggtattttagtcatactgttttttgtttatatggaggatctgatttacctaatctgcaacattaataaaaactagtatatgtattaacttattaatttaaagtgagtagaaaatgaaagggaaagtatcaatgaataggctacttaaagtagctgcaccggcacttttggtagctgctattatttgtcaatcagtaggttttcaaggcgttttagctaaagataatgttacaacagcatctagcgatcatgtttcaaaccttactgatcaacaattacaggcattaacaaatcccgttcttcaatcttataaagcagataacagccataaagtttggaaaatgactgctgatagtcgattagctgttctagcaaatcaaactaatatcgaaaatgtaagattgcaagaagtggtgaaattagtaaattcagaatttgttgaaaaaggaattatttcatctccattagcaatggtttttgctcaagaaaaagatgttagttatggagatattttaatcaatattgataaaacaaatccaattacaaataactctaatagcgaagaagcatataaaatcacaattggagaagatggagttcgtttaactggtgccagtgaaaatgctgttatgcatggattaagaacaatccaaaatttagctattactaatgatggtttagtttacggtgaaatcatggattatccgaatgttgcagaacgtagagtacatgttgactgcgctagaaaatacatttctaaagattggtttattcgccaaattagagaaatgtcttatatgaaaatgaatgctcttcaaattcatttttctgaaaatatgggatttagaattgaatgtgaaactgatccagctatcgtttctgatcaatatttaacaaaagtagaagttagagaaattttagcagaggctaaaaaatacggtatcaaagttattccatcatttgatagtccaggtcatgttgaccaaattttaaaagctcatcctgaatacgggcaagttaataatagcggaaatcattatagatctggtttagatgttactaatcctgaagccattgcatatatccgtagtttatatgatgaatatatggatttatttgaaggatgtactgatttccatattggtggcgatgagtatatggagtttgaccgtccgccattcactacagaatataagagtgtattaaactcttatgcagttgaaaaatatggtcaaggatatatttggaaagatgtaattgccggatatattaatgatttagctgaatatgtacatgatcgtggatttacaccaagaatttggaatgatggtgtttattacggtgaaagctcttatgaaggtgcacaaaaaataaaaatgcatgactatattggaattgatttctggtcacaaatgtcatggaattcaagtattgcaaatttacaaacattcattaataaaggtcatgatacaatttataacatcaatgcaagtttcttctattatgtattacgtaatgataaacctactgatggtagagaacaacactcatttgataatttgaatgcagatcgtaaaatctataatgaatggacacctggaaaattccaaggtaacccagctgtagatgataattctgattttattaaaggtgcttcaatgggaatttggtgtgacaatccaaatttatgtagcgaagatgtaattactgaagatattgctgatgaattacgtgcattagcttctaaatcatggaatacaagcagtaacgcaattatcaattttgatggtttccaagaaaattatgctaaattaggtaatgttgctggatttgaaaaaggatctacattaccagatgctggagaattcttaacagctggtgatttaggaaaaattactattcgtttcgtagatgaaaataatcaagaattaaaacatgaagtaattaaatacggaacagttggtgaaaaatttgaatttagtgctgatcctatttatggataccgtgtaattgataatacaccaattactggtacttacactaaagaaggtgctgtttatatattcacttatgaattatatacagataaggcggctttaaataacgaagtaacaaatgtattaaaagaaaaagattatatcaatgaaacatttagtgaatataaaacagcattaatagctgctaaagctattaatgataaaactgatgcaacacaggcagaagtagatgaagtatatgatgaacttatcgaagctaaagcaaaagcagttaaaatagaatattattcattatatgtacaaagtacatatccactaaaacaagatgattatgttggtggatatgaagcatataaacaagctgtagatgctggtaaagcattattatctagcgatactttaaatgctgagactgctaaaggagcttatgaagcaattaaaactgctaaatcaaacttagtaaaacctgatggaaacattccaacaattaccgctacagataactattacgaaaagaatcaatggtatccaactaaagaatatagttatgaaaaaatgttagataacgatttgaatactaagtgctggtttggacaagaacaagcagcggataaagaatttaaatttacttttcctacagctgtcaacatgacaagtgttcaggttattcagccttctaatgtaggtgatgatgcattgaaagctgctgatatcgaagtttcattagatggtgaaacatggactaaagttggatcaattactgaaaatgatttagattacacagcaacatttgaaaaaattgcagttaaatatgtaagagtccgcttaactgaggctaaaccaggctactggtatcaagtttctgaagtgaaatttgcttatgaacaaccacaagaagataacactttaagagatatgattaatgaagcagaagcattagatataaatggtaaagcccctatcttagtatctaatatggttgatgctctaattgctggtcaaaaagaatatgttaaaggtactactgatactacaactgtagaaacgactttaagaaatgctatcgatgcattaaaagatgcagctgatattactaatttatcaggactgatagaaaaagtacaaaaattaaataaagctgattatacagtagattcatggaataatttagaagctgcttataacaaagcattagaagttttggaaaatacaaccgcaactcaagaacaggttgataaggcctgcgatgatttagatagggctattaatgcattagttaaagctcctatagtagcagataaaactgaattattaaaagctattgaagcagctaaagacttagttgaaaaagattatacttcagaatcatggaagacattacaagatgcattggatgcagcaaataaagtagtggctaataaagatgctactcaagaagaaattgatgctgcagttgatgcaatcagtgatgcaattgataaattagaagttaaacctgttgaaccagaaaagccaattgaacctgaaaaaccaatggatccagtaaaacctgctaaaccaaaccaacctgctaaaccaggtgtagcaactggtgataatgcaagctttatggctattggaactcttatcgcagcaactgctgttatcgctttgttaaaaaaagaaaactaaattaattaatgataatggaccgtaaattatcataaaaagtgcggtccttctatatgtttatttatgtaagcgctttgatgaggtggaatgatatgaaaaaaattaaaaagctattgaaaattggactttctatagccattgtgatgtctggatttttagcaactgctaaagttgctaatgcatcaacatcattaatgacttatccaaatgttcaacaatatactaaagaagcggggcaagattttactcttgctgaaaatagtcgaatttttgtagtagtaaatgaaaaaacattaaataatactattttattaaaagatttaaaattaactagttcaaattttgaagccactggagttttagctaaagccccaataatagtatttggtaaagaagagaatgcagtagttaatgatattgttgttagaatggaagatgtggctgaattagaaggaaaagctgaaagctacaaattagatattactgataaaatcacagtaaccgctaaagatgaaattggtatttattatggtttaatgtcagtaattcaaatgttaaagattaatgataaaatattagagaaaggaactgttattgattatccagatgttgaattacgttcaatgcatttagacattgctcgtaaaccattctctaaagaatggataattcgtcaaatcaaagatttatcttggcaaaaatataatgcggttcaacttcatttttctgaaaatgaaggatttagaattcaaagtgatactctagatgcaatcgaaggatttaaatataaatatgatgatgtattaagtaaacaagatattttagatattattcaagttgctaatgattatcatattgaaatcgtgccttctttagattctccagggcacctgggagcagttttacaatatctgccaactgattacagttgcagagaattattcccaactgacgaccgtcgaaatcaatgttttaatatctttacaaatcctgaagctagacaattcttagtaaatttaatgactgaatttattgaattttttggtgatgctggatgtaaacattttaatattggcggtgatgagttcttagctaaattctctagttttagtaatgaacaatacggtcaaattatgacatattttaatgatatttctaagatagttaaagataacggaatgactccaagagcatggaatgatggtttattatttggtgattatgagggttatacattggatagtgacattgaaatttgttactgggcagctcctgaaaactgtgcttcggtagcggattttgttgctaatggtaacaaagtaatcaactattctgatgtttatatgtattatgtactttcttggtggtggcaaactaatgcagtaccggaaggtgatcgtatttataatgaatggcatcctggtaaattctctaacttatccggaacagcacaaacttttgaagaaccttatccagaatatgtaatgggtggttcttacgcagtttggtgtgatgatccaaattatgaaagcgaacaaagcgtagaagataaaatctatcatcgcacacgtgcaacagcttataagatgtggaatgcgaacgataatcaaccagactatgatgtttttaaagctgctgttgataaattgggaagaactccaggcttcaatgaggctttacctgctccgggtgaagtattccagggtgaagatacagcaacagttactatcaaatatattgataattttggtaagactattgctgcagatgatgtgttctatggtctaaacgatagtgagtatcattttgaagcaaaagaattatttggatatagttttattgaatcagatttaccattagatggtaaatataacggtaatatgacaattactttaaaatatcaattacattgtgataaaactgatttaaaaaaagaaatatttgaaccattagcagtaagtgaatatattaatgaaactgtagctgattataatgaagcattaacaatagcaaaagaaatatattttgacgaaacaagtggacaattagctgttaataacgcactaagagcattacaagatgctaaaaataaagctgttaaattggaatattattcattatatgttgaagtcacatatccattaaacgaaagtgattattcaagtggatatcaagcttataaaaatgctgtaactgcaggaaaaacattacttaatagtgaagaattaactgttgaaaaggctatagatgtttataatgcaattcaaacagctaagcaatcattagttaaacctaatgctaaagttccaactatttcagcaactgatacttattatcaatctaataactacaataatatgattgatggtaatattaatactaaatgttggtttaatagcaaccaagaaattggtaaagaagttaaattcacatttagtcgtccaataaatattagttctatccaaatcattcaaccaagcaatgctggtaaagatataattgatggtgctgatgtgcaaatctccactgatggaaaaaattggacaacagtaggaacgttggataattcagcatttgaaaaaactattacttttgataagacattgactaaatatgttagaattgttcttactgaaggtaaggggaactggtatcaaattgcagaagttaagtttgaattagaagaaatacctgaagattcaactttaaaagatataattttagaagctgaaacattaaatattactggtaaatctagtggctcagtaaatgaaatgattgatgcattaattgttgctcaaaaatcttatgttgaaggaaaagttgatgtaactgaagaaactgataatttacgtaatgcaatcaatgcattaagtgatacagttacctcaaacaaagaaaaactaacaaataagattaatgatgcaaaagaaatagaaaataataactattctattgaatcatggtcaagatttgaaaaagctttattagaagcaatcattgttaatgaagatagtaatgctactcaagaacaagttgataaagcacttaaaacacttgatgatgctatcaaaggtcttgaagctcctagtgatacaagtgaattagagactgttattgataaagcaaataagctggatgcaagcaagtatactgaaaaatcatggaacgcattacaaaatgcaattgatgctggtaataaagttctagaaaacaaagatgctactcaagaagaaatcaatgcagcagttgatgcaattaataatgcaattgataaattagaagttaaacctgtcgatcctgataaaccggcaaaaccagaaaaaccaattgatccagtaaaacctactaagccaggtgttgcaactggggacaatacaaactttatggctattggaactttactagtagcagctactgggattgctttacttaaaaagaagaaaaaagaaaattaattaaacctgaatccgtgacgaattgtttatcacggatttgcttaattataattattctagctataatttaatctcagttaccctgttttaggacatagtaaaatttagatgttaaactattcttagatttaatattatatctgagaatagttttattttactggtagaatcaagagatgctattgttaattttagctaaaactattgaattgaggtagaattaattcagtattgacaaatatgtaaaacaatttgaatatgcgtatgccttgaagcagtccgaaggtgtgtttgataaagaagaattaactccttcaggaatgctgacttgtagatacggctttcatttggaaattacttatttttttagcagtagcttgttatgcgatagaagcaatcagattttctaaaaaagatttaccgttatagaaaaatgtcactggacagcaacacgtaaaatggttaaacctcttactatgataaaaataaaaactgtcattagaaaactataatgattagtataaaggttaggtcaatgataggttcaagcaatcaaagtcttcaaacatattatggaggtgcaaaagtgctctctgcagataaaggagaagcagatgtatttatgtttgttgacgattctgctgttaaagaggttatcgttaatactgatgataaattgttacaagatagtattgttatttcaaaaagtataaaagtttctggaaatttggaaaatgaaagagaggcggatgaaaaatttttaaaatctattcttgaggactttttgaaaaacagtttagagcagtaaaatggattataaggaaaggagattaaaattttgtctatagcagatataatacaaattattttaagtattctatcactactagcaactgttgtagtttcttttcaatatactatctacaaagaaaagacgaaaaagaaatacaaaaaaatgaggaaaatttgcaaaagagaaagttaaaagaacaagcagaacattttattattaataataattccgaagtagattatttgccctggtgtgtttttgcttcgaatcttcataaattagaatctcatcatagaaaaacatataaagaatattgtaaatgttctccggaagtacaagatgaaatactaagaatacaaggattaaatgtcataagttattatcattagaaagacgaggtatttaattatgactaaaccagcatttacagatgaatttaaacaggagttgttcagtatgtgcttgatcatcctgatgtatccattgctactttcgcaagatataagtttgttcttattcctgctgtagctgttattcccgttgtcttataaatatcctgaataatcatttttgcaaattcccttggagatttattaacagtcttaggatagctcgttacatcaataaaaacctcatcaattgaataaacatgaatatcttcagccgagatgtattttaaatatacttcgtagctttttttactgtaatcaatataaaatgccatcctcggaggggcaataatgaatccaagctcaagacttgagtcattttttaactctgaatcaatatgtgattttcctctaaactccctacaccagttatttttttctttttctattgatttctttaaccctttgaactacttcaaagagccttgttctaccgccgataccatactgtttaagagaaggagaaacagctaggcagattgtcttttctgttttagttgaatcagcaaccaccagattaatattcagtggatctaattctctctctacacattctacagaagcataaaaagattttaattctatagccatatacatcctgtttcctgaactcatcattctcacctcaactgcctttaatttaattattaatacatcattaaataagcatagataaaatatgtctttcaaccatcattatacttgacgcatacaataattaggtatttatttgtttttcgagcgatagttttcccaagatattgaattgatgttttttattacattattaaataatggagcattttttttatcgtaaatagcataaaaatttagagttgctactgaatctattataggaatataaactttattttcgctatttttaagagatggaatggtaagatttgttctaaatacaggaagactagaagattttacaagtatattatatgtatctacattatcctgaaataggaaattactggtaggcatattttgtgtagtgatatcgtaccagtatcctattctgcttaatactaaaaaattatagccatctatatctttaaaactaaccgctttaaactttgataattcatgggttttatcaacgcttatatataattgttccttacatatctctttgcattcacaattaggcaatttcattgggtaatctaagataatcatggagtataggtgatttctaaatgatttaattaaaacttcattgtcatttattatttcgccgatagaatgatctaataaactttgaataccccatagtggtgcaggtgcatttgatccaattgttattctaaagttttgttggaataaagcgtttgtagatagttttaagagttctacctcacttaaaatcttttttgcatgagcgattacttcttcgccgtacatatttaaaactaatctgttttttacacgatcaaataacgcaaatccaaattcatcttctagtttttttatagctttggtgatggacggttgtgagacatgtagttgatttgctgtctctaataatgttttatatttttccaatgcaaccaagtactctaactgatataattccatgatgctcacctcaatatatattataacctatagttataattatatgcaaatcatatattatttttattaactagtgaatagtataataaagatgaaaggaagggattgttaatgattttatactatacgtcaacaggaaatagcttatatattgcaaaacaattaggaggtgaattgatttcaattccacaagcactaaaagaagataatttaatatttgaagatgatgtgattggaattgtctgtccagactattctgcagaattaccaagaactgttagaaaatttttagagaaagctacactcaaagcagattatgtttatgttatcattacttatgggaagttagatagtattgtagcttattggacaaaagaatttgcacaaaaacatggtattcatttggattatgttaatactgttttaatggttgataactggttacctagttttgatatgtttgaagaaatggctattgataaggaaataccaaaacagttggaaaatattaagaaagacattaaaattagaaaaaaatttgtgaaaggatataccattgaggataaaacagcttgggaaagtgtttcaaagagaaatagagaatcacctgaatggacagatggaacagcgttacattgtgatatagataaatgtaatggctgcggtatttgtacaaaagtttgtccagtaggaagaaatataataaaagatggtaaacgttttgaagtgacaaacaaatgtgatttctgtttaggatgtatacatgcatgtccaagaaatgcattttatttaacaatcaatgataaaaacccaaacgcgagatatagaaatccgaacattaatataaaagaaattatggatgcaaataatcaaagatagagagaaatagaggaaaagttaccatcagtgagattatgagtgtttatgattctcaatcttagaacagaagagcatctggaacaattaaaagaatctcatttcaaaaaggtttaattatcagctgtttttttagatataattgtaaataattatattgaaactgttacagatacctgtgttgaaattaaaaatggcttcaacgtcatatacaagaatcaattactaagagtaattaaaatagtactatttattaatgaaagatgaaataaaaatgtttatacagttattatgtagaaacttataaattataaatatttcattgcgtggattagaatatggactttaatacttttagagggtatagaagaaaacaatgcagtaataatgaagtacaaatataggaggaattataatgaaaacatttaatttaaataataatgaaaatatcccggttattggatttggagtttttatgataccaaataatggtccaacatatgaagcaactttagctgcattaaaagccggttatcgtcatattgatactgcagctggctatatgaatgaaagtgatgtaggtaaagctataaaagatagtggtgtaccgagagaagaaatatttattacttctaagttatggctacaagattatggttatgaaaatgcgaagaaaggaattgacaattcattaaaagcattagatactgattacattgatttgtatttattgcatcaaccatatggagactatttaggttcatggagggctttagaagaagctgtagaagaaggaaggataaaatctattggtatttctaatgttacaattaatttatggaataagtttaaagatggaatgcatatgatgccagttgtgaatcaagtagagttcaatccttttacacaacaaaaaaaattgaaggaagaaatgtccaagtataatattcgtttagaagcttggtatccattagggcatggtaataaagatttattagaaaatgaaacaattgtttctttagctaataaatataataaaaatgctggacagattattttgagatggatttatcaagaaggagtaatttctttgcctaaatcaacaaatatagaaagaatggaaggaaatatagatatttttgatttcgaattgaataatcaagaaatgcaatctataagagatttggatactggaaaaccaacacataatccggaagattctgctaatgaaacaagattaatgggattaaaaatacacgattaaaaggagaaattaataatggattatattacattaaacaatggcgttaagatgcctcaagtaggattcggtgtttttcaaattaaggataaagaagaatgtgtaagagttattttagatgcaattgatgctggatatcgtttgattgatacagcgcaatcttatggtaatgaagaagcggtcggtgaagccataaaaaaaacaacagttccacgtgaagaactatttattacaacaaaagtatggatttcaaattatggctctgaaaatgcaaaggcttctatagaagactcgttgaataagatgcaattagattatttagacttggtattgcttcatcaaccatttaaagattattatggggcttatagggctttagttgacttatataaagaaggaaagattaaagccattggtgtttctaatttttatccagatcgtttggttgacctatgtttggatatggacgtcattcctgctgttaatcaagtagaagttaatccatttcatcaacaaaatttagcattggaatataatcaaaaatatagtgtacaattagaagcctgggcaccatttgctgaaggaaaaaatggtatttttgaaaataagattttgagtgatattggtaagaagtacaataaatcgataggtcaagttattttacgttggctagtacagcgaggaatagtacctttagccaagactgtaagaaaggaacggatggaagagaatataaatatttttgattttgaattaagccaagaagatatgaatataatagctcaaatgaacaaggataaaagttcttttttctcacattatgatccaaagacagtagaaatgatttgtggcttaaaacgttaatttacttagtttagataaatgatgggtatttgcacaggtactttaaagtatttgtgcttttattatatatatatttaactaacattttattatattttatcaataaaaaagcagagcaacgctggtgttgcctgcatagatgagatccaacagattggagtattcccatatgttcataaaccaaagataaatgagaaagttattggttatattcaaagtgctgatgaaaacggcagattgcaataagaaatatgactttgaacatctgataaatcagtgtaaaagggatatgtttgaatttagtgaaaatgagctagtaaaaatgtatcttgatggggatattttttacagttattgaagcttgcttgaattatcctgaatgcagatacataaagaaaaaatagggcataacttttgatatttaatacgctggtattttcaactctcgtctttacagagttgattgaaactgatagctgtattccaggttgttttataaagtgaaactggtacataaataagtccaacacttatagcacttttgtgtgcaactgccataatatcattccttctttcattaatattagatttgacaggaatcgaggaaaataaacaaaaatcaatactttgttaaaggatatatatcattagaaaaatgacgtgattatttattcgtgttataattttaatgaaaaaatttaaaattgttaacaggagaaagaaaaatggttaaacctcttactatgatagaaataaaaactattataaaaaactatattaaagatgaaagaaaaaaacaagctgttcttttaaatggtgaatggggatgtggaaagacattttttattaaagaaaaattaattccagatttagaagaatatcaaatacttcaaatatctttatacggtatatcgagtacagaaagaatacaagaaataatttatagcaaatggatcgaaaaaataataggcaataacacagataaaattggagtttttggtaatatggtagcaaagggcatagaaatttttggtaaaagtgctactcaatttgtggaaaaaaggttaggtgtagaaaatacattagaagatataaaaaaatattttgctgattcaaacctttcaaataaacagactattttaatttttgacgatatagaacgatgtagaattgaaataattgaattgatgggttttctcaacaatttgtcagaaaataataattataaacttatactcattgcaaatgaaaaagaaatcacaagagatgaaaatatcaatacaacagcattaaaatatgggattgcattaaatgaaaggctggatattagtaaaattaaaaaaaaggaaacagacaacgaagctgataaaatcaatcgtgaagatttgattaatatcataaagtactattttggtcagactactacctatgaaagaacaagagagaagttagtaggattaacagtaccatacagtatcccaattaaagaatcatttgatgctattattaataaatatgtaaagaaagagaaagattcagttactaagattctaaaaaagaataaaaatagaataattgaactgtttgaatctcaagcacataaaaatttacgtactttaattgtttcttgcattgcgatagaggatattctttcttcgatagataaaaatcaaatcacgaaagatgataatatgttggctgatgaattagatgctattgtggtatatacaatctattcagcaattagaagaacaatgggaaaagaagaatataaatggtcaattgggaaccgctatggaaaggtaaacgttagtattaatgagataaaagatagtaacatatatggatatgcatttgtcgatgaatactggaaaatgcaatgcatagatgctgatattgtccattcagatataagaaagagaatttctgaaagaactgaatatgagaatcgactaaaagcaaatcataattatcaaaaattatcattaaataagttaagagaatggtatatattggatgatgacgatatttatagctcacttgataagttaaaaaaagaattagagtgtaagaaatactatccacaagattttaaagatattattactacgttgctgactataaataatccaaattatgggttaaattttaatgaaagctctgacaatgtactatatgatacaactgataattcacaatttgcagatataaatttaaataatcaagaaatacaacaggatattaattttaagtggagaaagattgatatagcatcatatgttgaattgatggttcaatgttttgatgatcctgagtttaatttaacaaaagatatgttacgtgtactaaccgaggataaacaattcgcatatagttacactcaattagtaataccattaatagagcagattgaaaaaaaagaattacacgatatgcaggaaaatccaataataagtatgccatgggataataactttgaaaattattgttatgataaaaggagtgatttcattaaattaggtagatttttatcattgtttgattatcatgatttaactaaaagattggtttatgctgatgctaaggaaatacactatttttttaggtcattggaagaagtatattattttgtaaatcttgacagtatttattctcaagattatgaaattgtaagaaatctaagaaattacgtttcaagtaatatagatactgtattaaataaaaagagaagtaggactaaagcgatttggttaaaacaacttgaaattaacttggaaaaatatgaatcagaccttgaacaaaaatgaataaaaaaagatgaattataacaactctgagaaattttataaatgaataaaattattaatagtatttaagataggtgactaaagaggacgataaaaccttaatttgtcagttaaaagtaaataattaatgtttaagtgtgtagttcgttgaattacgcacttttaaattttataatcgttttgaaatcagtttaattactaatgatgtgttaataattaaattaaaggcagttgaggtgagaatgatgagtgcaggaaacaggatatatatggctatgggtaccataaatcaggtacccttttagttggaatgatatactgttattatcagacgaatccaaattcctatagaataaaaaaacactttcaaataacgaaagtgtttttctattttcataattatttagttggataagtaatcgccaatcttgttaaaataccttttttgttttcagtaacaaactcgtatttatagccttgatcatcagtataatgccaatgtccatcagtgttttgtccaggactaccaatccattttaataaattgctacttgttgttttaccattcattggaatttctcgatcgttattagtgacaaatacagttgtcttgatgccatggtgattttcttcttccatgattgtatcataatctaaagttatttgcgttactttacaatcagctacagctaattttttatcagtgtcgtttacataacgaattccaaaccattgccactcatcttcgagatcatcattgtatacttttaagaatgctaccattgaagaaatacctccagcagcaagatctggtgccttatctaccgttttaccagtatcacctaattctactttagtaccaattttttctaaatagcgtacatattcgcctacagtttctggtaaagggattttttcatcatcaatagtaaaatattttattatccctggagcttccgtaaatggccgttcttgagattgtgttgtcgttgttgtatcgttatcatcggtatccggtgtgcttggttcatcattactacaagccgtcattgcaaacatcatcgttagggccaaaccaactgttaataatttctttagcatagaatttctccttttttatccatatatcaatctcattataaatactttttttagtttaatctacatttttagacaattttatcttattatttcttaatattactaataaacatactaatttcatcgattattccttgtttatcagccacatattcctttggggtgaaattataagcgttatttactagttcgtcaagtttacttagatccgtacacggaataatatatccttgtttatcaaagcgttccatgatttgtacttgatggtcgttattttgttctttatattgacccaatcgaggcacgactatcgttcttttattcagcttaagagcagatacaattgctccaactccagcatgggtaatgactaaatcagctatttcaatttgatgcagtaattcttcttcgctgtaatattcttgacagtgaatcccttgatattcgcctttagtgtaccctaattggacatagacctcattttctttaacaaactgagaagccaaaatagcatttaacaaacgatcaaatcgtttatcttgagtcccaaacattacaaatattcgcattattttagtcctcctcgatatttagcattaggatataaatctaacatctcttcccattggactagaaacaaatcagcaatcggatagactagcttacctgataaagttttggtagtaatattggcaaatgtttcaataaaaatcacttttttaccaaacattttagcaatatagcaaataggaacagtagtatgagcccccgttgcaatgacaacatctggtcgaacttttaagtaagctttaaaacttctaaaaatattaattggaaaattgcataagaatttaaataaatgttccttagtcccagccggcatataccaggagcgtgatttattagattttttatactcttgcatcatctcatgatcttcggtaattaaaaatgaattatagcgctccattagttcgtttaactcacatagctcactaaaatgaccaccagctgacgaagtaaaaatcacccgggtttttaaatcatgaatattaaagtttttaaattcttttaaccattgttttcttacattattataagagtactttttagcttttttgatagcattattttgcactgttttagttgtcttattcaacaattcgacaatcttattagccatcgcatcaagattacgatctttgataataaaaccatctttaccatcatcaataatatccaaagagcctttagcactatcaaaagaaacacaagggattccataactcatcgcctctaataatactaagccaaaactttcataatgtgatgttgttacaaatacactagtgttttccataatctgcagtttggctttaccaacagtattaccatgaaagacaactgatttactaatccctaactgatcggccaaaagactcagcgtcgttctttgatcaccatcacctaaaatattcaacttagcatcaggtttttgaactaaaactttttgaaatacctttaacatatcatcatagcctttttcgaccgacaaacggcccattacagttatttgattagtatttaaaggagctcgattttcaggaatttcatcaatacacaatggtaaatagcgacattgcggtcccgttaaatactctttataaaattcatagattgatttagaagcgggaataaataagtcaaactttttaactgctcgataaactttctttgaatattttggatcacgatcaggatgacaatgttcccaagcaatcaataatttatttttttgatacttagcaaaactaaaattaaaagctaaggtgcttgaaataataatatcgccatcattatctttagcacaccgcttgattaaacttcgcttctttagaaccacttttaatgctttaaaaccttcttttatcaatttgacatattgcttgttttttaaagcatattttaattcttctttatttggtttcaagtcagtagataagtaagttacttttacacgctcatcaatgtaaaaagcaggtttgcatagcctatagacatttacaatttcaacatcatagtcatcaactaacatgttagcaagtgaacaaatagctttttcaataccacctactcgtaaatgtaatgataatatcgtaactttttggcgaggtcgcttatggatattaacaatttttttattagttcgtaaataagcaaaatcacaagcccagttagcggttctctttaatcgtttcaattgatgcgaagagtgcttaaaacaagtttgatgataatacatttgcgagtcttttaaagtacgtaatttacgataatgattaatatttttatcaatcgtcactgagtgattgtggataacatgaatattattcaaaacacaaggttgcatcccggcagccttggctttagcacataaaatatcttcttcataataaagaaaagttccttcatcaaaaaatccaattttatcgatcaaagcctttttcatccccaaaaaacaccccgaaatacaatcaactgcagttatagcccctttgtaatgggacttacgatacttaatcgaacctttgaataagcgattaatgactggataattatcacaaatatcataagcaattgttttttgtttccagccatgattaagcatacctcgttcttcaatggtcggtccaaataactgataacgcgtatcggcattcatatgaccaataaaatccattaaattacgcttatcaataatgatatccggattagagacaatgtaattatcacaattttgttcatataaatattttaatcctgcattattgccagcagcataaccacagttattctttaatgcaatcagttcaatcttttttagcttctttagttgttttactgaatcatcagttgatccattatcaacgacacagatgatatcaacagcattaaaattactaattttttcaacaaaactgatagtctcgactacatcattatagtttaagacaactattcccgttttcattaactgtcctcctattcctttattcccaatatcgtatgattataaaaagatgatgtcttttgaacttcattattcaaactactaaaaccaatttcttccatgactgtttgcttatttgaaaacaaattagtacctaaagctaatctatcgccttcaatcgttgctcccatagctgctaacatcgttggataaagatcaactgtactaaatagtctatttttattattcgaaggttcaatagcactattgataaaacaattatacggtgttcgtaaataacttgaatcaattccgctaaagaatttttctgacatactattatgatcaccagtaattacaattgtcgtattatcataccaagattggctcttgcaccatttaacaaaatcgctaatttgtcgggattgacactcaatcacattagcatactgatttttatgattttgtttacagagatcacacaaataaccatcaggtgtatgggtatcaattgtcgtgatttccatgttaaacggctgatctccattagccaacttcgttatatcctttttagccagctctaataacttagcatcttcaattccccaaaacacaaaataatcttcatcaatttcgcccgcttctttaaaactattataatcacgaatcaaataattaccatgttgtttataaaaattcgatgttccgccaaaattagcatccgaaccacacataaattcattaacataaccattatccgttaatatttgacctaatgaataaccaccaggtaggaattcactttcattatcatacttttcactcttaattgaaagacttaaaggaatacccatattttgggatacttgcgaggcaattgtccattgtgtcccatcaattgtatagctgccaccaatgttatcattattcgaaaaattaatattttgatgcgccaaatctgataattcctggatataattaatctcttcggcaccacctgatttttcatcagcataagtattctctaatgattctaaatataaatgaataatatttcgtttaccctgttcaaaattaatatttacactacgaggatcaacatagtactgttcatacagaccagtatcctgaaccatattattaatatagccataaatgtcataattataaatcgtaaaaatcaatgaaactaatagacataacactccggctttaataaaatgcgttttaaaaaaattaaagatttttgattcatatttttttatcaatttaccactattaaaaataattatattaattatcactgttattgccaaactaattggtactgaccaaataaaccaatcaagatatattccattatcagttccttccatcggaacctttaagtgaaaaatgatttgattcaatgttttcactgaaaaagttcgatttccccaaataattgacacaattatcaaaacgctaataaaaatcaatagtgagccaatcacccattttttacttatattctttattttatccttcatcattattcctctttaattaattctttactattctatcatatccaacaaaaataataaataaaagaaaaaaatcccacaaaatgtgcattaattacctttttaatcataaattttattatgtagcaaaaaatatgtctccagacaagctagagacatatttttataaatttctcattttaattatatcatttacctttttttcagctacataatagattatcattccacatataatcgctattggcactgccaaaacaaagttcagtaaataattcatatgaccaccatttaaataaacaatgctttgttgaataggaaaaccgcataaataaataccataggctattgcaccaagattattagcccaattattaatttgtttaattccaaatgataaaaataccaaaatatatggaaaaaacaagaataatcctacccaggctaaatgaaagaaaatagttaacaaaaatccagtaatcgatatgataaatattttcacatcaaaatatacagtatctttatatacgtacaataataccccaacataaaacataaacattggttctaaatagccagataataatattattattggattagctattatatttaaacctatgaatataataactgttggaataatggtatatttgaaaaatttctttttagtcaacgataacttgaaagcaataaacaaaataatataacaaacaaattcgactggtaaagtccataaagctccatttattactggcccataaatattattttcaaaaacttctggtaattgatggataggaattaaaatagcatttaataaatatttataagtatcagtagatgtaaaatattgaataatgtctaacttggtaaaaaacaaaccaaataaaataatactcataactactgtaaatatcagtggtggaaagattcttatacatctagctttaaaataaaaagatgccttattttttctttctacactcttagcaaccaataaaccactactaataaagaagaccgcaacagctaaactcccaaagcttaacgtgccacctgaaatttgtaataacggatcaatgctgtcttttcccattgaaagcggataggcgtgacacgctattaccaaaattgcagaaataaatctaattaaactaagattactacttctaatattaatacaatctactaatttgttgttatccatggctaaccttataattttcgattattttattgattttagttacatcgccccaaatggctggagaatcatacggccgttcaggaaatttcccataatctggtctaattgaaaaattatttttatgaataaactcatcaactttatcagctaaagaaattggtttaccactacagcaatttatcgttccaacaacatctgattgaattgatgccagggcaatttgcctgcttaattcttctacatctataaagtcatacatatttttcccagatacaaatgggaaagttttttggccttcttgttccattttcacaatctttgaaaatatagaattattattaatatcatcacctaaaatataaaatgctcgcaaccaagttaacgtggtttcactagctgcagtcaatatttctaaagcctgccgtaaactgtttttagcaattccatacattgataaaggcttagttggtgtattttcatcaattgccccttcataatatcctacctcatgcattgatcccattactgagatatgatcaattttcatatcaatcaatttttttaaaaaactataatgatcagataacatttccatatgggcattagaattatgcgaaaacccatctttccaagctaagtgaatacacccatcaggttcaccaatagcttgataaacatttatttttttatcaaagatgtcaactacctttttttctgcccgcgcatcaataaaatcacccattgatagatcaactgcgattacctgatggcctaaatctaataacgaactaacgacgtgacgtccaatatagccgtttgctccagttactgctattttcataattacctccttttttaaacgcaatatgcgctaaactgattctatttttgttatttatacttcattacttttttcactttgtgaatagactctattaattaattttgcaatactttttggccaatattgcattagtatttcaagatcctcttttttccggatattttcacctaaattttttgaagttgctgattcagcataaattcgatgtccaatcaatttttctttaatataaataaatcttccttttttttgagctaaatcacaccaagttttataatcacaactattaatataattagtgtcgaatattgaatcaccagcaactggtttattgaatgtaacagctgggcaacaaatagcgcatcccatcgataaacaacgatttcttataaatctagatttttgaaatattttaattgacattaaataattcatacagtgtttaatattaagtaaaagatttttatttactcttttccctttttttatttcataatagtttgtaaaagccattattaaatcatcttttctttgaatttgttgtaatgttttttcaagaaaatctttttcataaatatcatcctgatgagcaattgtaaccagtggagttggtgcactattatatgcccaattccaatctgatccagcatttattggatgttcatttacaaataattgcaaattatatttatcacataatccagtaatgtgatcattaacggtagatgtagatatatatatcttactttttacagtttgattcaataaagactgaatggtttcttctaaatggggattttctttatacgcacatataacaaaactatgatctttgtttgtaaacatttctatacacctatttccttaatatatcgatctaatgcatctttccaatctggaagtcgatcaaacccatttttatccaactcagttttattcaatctgctgtttttagggcgtttcgctttagaaggaaattcctcactagtaactggatttattataatctctttatctaaataactcaatatttctttagcaaactcataccagctacattcaccttcattggtaacatgatatgctccatatttatcagtttggatcatatcaacacaaagaactgccatatcttcggtataagttggcgcaccaatctgatcatcaacaacattaatttcatcttttgtttgaccaagttttaacattgttttaataaaattatttccattaatgccaaaaacccatgaagttctaacaataaaatgcttttctactttttcaacaataagttcgcctttatattttgtttgaccataataatttaatggcgttctttcatcatactcaaaccacggtttagttccatcgccactaaatacatagtcagttgaaaaatacattaatttaatatcattttcagcacatactgtagcaatatttcttgttccctcaacatttaccaaataacatggttctttcttgtcctcggctagatcaaccgcggtccaagcagcacaatgaataaccgcatcaaaatgatcagctaagatcaacttttgaacatcctcttttttagtaatatccatctcttctttatctacaccaacgacatctatttttcttttttgacactctttaacaatatcgtggcctaattgtccattaacaccagtaactaatattttcatattttcctcctacttctatattattaattagaatatatcacaattttaataatcttaatagtaaaaatatattttttgcagatacatcaatttatctattgtctttttcattttaccatataatttaacacctaatataactatcttactattttcttgatttaatgcgcctttgcaacaaaaaaggaattgaaattattgtatcaataaaatcccttcctctaatatccttttacctaaacaccatttgcctcaatgtaaacagctgccttcataaaattatcaaaatttaaacagctagtaagcggcttttcactaatcaatattcctgtgattggcttttctttacaaatcgataaatctctttcattatccccgataacaaaagaattactccaatcaacatcaaaatcttgcattgcttgtctatataacccagttttgggtttgcgacaatcacacttatcttcatcattatgaggacaataatacaccccatcgatagtaaccccatggttttgtaatctcgccttcatttctgtcataaagatttcgaaatcatcttttgtataataaccacgggcaatccctgattgattagtaataattactaatttataacctagtgcctgtaacttctttaaaccatctatgacaccgtctttaaattctaatttttctatttgataaacataaccataatcaacattaattgttccatcacgatctaaaaaaacaaccttatctttcattctactcaccttttattttagaaataatatttgtagttgataaaccgccagctagatcaataaactttacaaccccaccatacgattcaacaatttctctttctggtaaatatttgttttcccaatctttaccttttacagtcacacttggctttatttctctaatcaaattgcaaggattatcatcatccattagaataacataatcgacatactccaaagaacatagcattttaattcgattattttcatcaattatcggtctactatcgccttttatttttcttactgatgcatcaccgttaactgcaacaattaagacatcaccaaattctcttgcttgtttaaatgatgatagatggccagcatgaagtaagtcaaaacagccattagtaaatactacttttttatttcgctctttaaaattcgaaaccacatattttgcagttgttacatcaattaatttataatcatctttgattgctagactactgatcaattcatttaaagatactgtggccgccccaaattttgaacatacaattgacgctgcttgattcgctagaatgcagcatgtctcaatatcaaaaccagatgaaattaataatgcaatcgtactgacaaccgtatcccctgcaccagttacatctactacatcctttgaaatagctggatagtctttcttaactccttgatttgccgacaataaagatattcctttttccgatcttgtaattaataaatgatctaacttcacttggtctaaaagaatctgtccggcattattgatttcagattcagtatttacattgagacccgttgctaattttagctcttttaaattaggggtacatatagtcgcattttcatatttactataatccttacctttaggatcaacgataacgggaatatttctattccgagccttttttattaacgcttgtgccactcttttggtgattgctccttttccatagtctgacaaaataatcgcatttttatcagtaataatttgatctaaattacttataatataatcttcaatttcactaggaatatctttgatgatttcttcatcatatctaagaaactgttgattcttcgaagctaatcttgtttttgatattgacttaactttttcattctttaaaagaaactctatatcaaccccacttgaagataactggttgatgatccagtcaccatcaggatcctcaccaacgcatccaataacactagccttggcacctaaagcaataatattatttattacatttccagccccacctaacttcgactctttgctttttacttctaaaataggtactggggcttctggtgaaatccgcgtaacatcaccaagaatatatttatcaatcataaaatccccgtatacaaggattgacgcattactcaacttactaattttctctatattcattatattttttcctccacaatcaaatctttaacttttttccatgtttcctctttagttatttgctcaatacatggaaaaacattaaatccataatgcttacatctgttattacaattataacaatccattttataatttgctagtacgggatctttataaccagaagtagcataattataatgagcatatcttgtataagtatagcctccacagatcatgactgttggtcgctgagtcgctacagctatatgataagcactcgtatcattggtaacaaccaaagaagctctagagattacttcaataaattgcatgatattggtttttccaatcacatcaatatattgaatttcaggtattaaagctaataattcatcaattgtttttttatcatgattagttccacagacaagcaaaggtaaattggtaaacttctgtatctgtctggctagataagcataattgttcaaatcccatttctttacatccatacttgctgttggaaataaaataaaaaacttttccggtaaatcaagatcaattggggtacttggtaatttagcgggataagcattgacattttttgctcctaatttactaaacagctcgccataaaattgaatcaaatgaagattaggtttatgattttcaattattttagtataaatcttatttatttttcttttggaaacctcaatacttggcaaggttttatctaaaattccaattttttcttttgctaaaattgctctagtaacaaagatattcgtcgtatacccatcacaaccaactggatcgattacaatatcatagtactcatttcttaattgtttaaacagatttcttctattttttaggttgattactgatgatgtaaaatcaaaaggcatgacattatcataaatatcatttgaacgatacaaatcagcaaacgctttttgacaagcaatcgagatctcatatttgtcgtgaggataaatatctcttaaggctttgctaaccccataaaacattaccccatctcccaaagccatattataaacaactaaaactttctttttttcttgtttaatatatttaggcttttttatacctaaaagtaagaaccagtcaatatagaagaaaacggcacgaattttttgtaaaaaagagttctgccataataattgattaattttcaaaaaaacattagatgttgtataagtatttttttcttgtttcatattttctcctgttatgaagttatcaagcaaaatttatttgtcttgatgctttcctcatacccctttcttcttattataaaatatagtgagactagatctcactatattttaaacacataatgcgttttcgatttgttcacacatcatatggacaatcatctcatgaacttcttggatatgcggtgtgtaatcaaaatcaacaacgattgtataatcgcacatttctttaagctttccaccatctcttcctagaatcccaagggtaataacattttgtttcttagcttctttaacagcttcaattatattatttgaattaccacttgttgatataccaataaaaacatcaccattttttcctaatgcctctagctgtctggaaaaaattacatcataactatagtcgttagcaatacttgtcatatttgacgaatctgtcgtcaaagcaattgctggcaatgctcgtctttcctttaaaaagcgacccactaattccgctgcaaaatgttgtgaatcagcggccgaaccaccgtttccagctaataatatcttgttaccatttttcaatgaatcgatgcagacttcgattgcttgttgtagatcagctgcaaatgatgtttcttttaaatgttctaaattttgaatttgatcatttaataccttagttatataatctttcattatatttcctccgttcattaaccttattatactaataattctttaataatccaaacagtttaatcaaactttttgttaatttgcactatatataaaactaaataaaacataaattgcattactaatatacaaaaataactcattacacttccatatacaccataaggctctactaaaagcattgaaataattatacttaacactaaagtgatcaactgtaaataaagttgttctttagtacatcgtaacgttattagagcatttaatagtatctgtgagatcgtataaaaagcggctccaataattatcaatatcaataacatccgatactcatttaaattgacaccatatactatatttaataccgggatacctaaaaaataagctactggaataataacaattaatgataatacaattattgatgatattttcattactattttattaaatgccttcttttgattagacctaaacgaagtcgctaatccagttagtgagggttgtaaaataaattgaccaaagagcattataaatgtcgccggcatactaactatcccgtaaattgcttggacactatcggtcgataaatagtcaatcgcatacttaggaatattaatggcaaccataacaatcaaggaaaaaaggcatgtatagcccgccatttttaataatttcttaacttctttaatatttaatttatagcttatttcagtctctttactagcatttcttttatcataatataacaaaaacaataaagttataactaccagtgctatacaactgatcaaaagattatctgttaatttgtcaacggccaaaaaaacgattattgaaacaagagttcgataaaccattgattttccagcaatatataaattatctcttttttgatttattccatagtaaacatcacaaatcgcttctaaacattttaatgaacacaaagaaacaaaaataattgatttatccatactataaccattaattaatgtaaatagaatcgatataacaataccgccaatagctgttaacaagcgagttactacatatgatgattccgatatctgcttattatcatcggttacttgataggttcttccacaataaagggcaaatatattaatgatacaagctgacgaaaaagaaaaactaaaaataccggccatctccattccgttgattctagttactaaaatcattaatattaaagaaagaaaagaaacacaagcagttcctaatgtattccaaatataatttttctttacattatttatcatttttattttccatttctgtaactttctttttcaaaattgacatttcctgaattaataaattgatcttagtagtttgtccggcaataattattgtaagtgccatgattataaagaaaagcaatacaaagaaaaatcccacggctaaatttgaaatcgttttaaaaccaaagatattcgcgatacttaagaaaaattggggaacaagtgctaaaacaataattgcaacagcgggaatcaaccaaacgatggcaaacttcattggcatccgtccttttcgcaagacaatcaagacaattacggcaatcaaaataccgattaataatagtcctcctactaaactacttgacatgtttaaacctcctcattccaacgactaaaaccgatagtacaacatttatcataaaataagcgcttttccaagatctaatcgaagatactccaccaattctttcattcatacttactggtacttccaaaatagtgtaattctttttcaacaactctgtattagtaattggttcggggtaatcaacgggatatgacttagcaaaatcttcgattactacccgattagcagctctaaaacctgaagttacatcataaatccgctttcccgttactaatttgatcgttgttgaaataatcttgattcctgctcgtctagctgctgaagactgaaactcacttgattctttattaataaatcttgaaccaattacaaaatctgctttaccatcaataattggttttacaatatcctttacataggtaatatcatgttgaccatcaccatcgtattgtaatgcaatatcatagttattagcagcggcatatttatacccggtttgtacagcaccaccgattcctagattatgtatcaatggaacaactggaatattgttggcttgacatatttctaaagtacgatcagtagagcagtcatttataacaagaacatcataatttgttccattttttttattataatcaattatatcactatatgtttttaaaatacattcttcctcattatacgcaggaattattattaatattttttccatcatcaaccatcctagcctttctttacgattataacaaaataacctatatagttgcaacttattattattttagattacaattagcttgatttaaattattacttataagaaaggactttatacgatggaaatgcaaaaaaaaagaaattgtattattggacaatctggaggacccacaatcgcaattaatgcaagtcttgcgggaattattcacaaagctaaaaacagcgaagaatatcaaaatgtttatgggatgatcaacggcatcaaaggcttactggaaggacgttatattgatttgcttaaagaatttgataccggtgaaaaaatcaatgctttaaaacaaacaccggcaatgtatctaggttcctgtcgttttaaattgcctggtcattgtgacaatcaggaaacttatattaaattatttgaaattttaaataaattacaaattactgatttttattacattggcggtaatgattcaatggatacggtcatgaaattagatgactacgctaaagctttcaatagcgatatccagtttatcggaattcctaaaacaattgataatgatttaatgggaactgatcataccccgggatttggttccgctgctaaatatgtcgcttcatcaattcttgaagtcgttcatgatagtttgatctatcaattgcaatcagttacgatcatcgagatcatgggccgtaatgccggctggctgacagcagcggccgctttagcccgcaacgaatacaacgatgctccagacctgatctatttaccagaagtagtttttgacaaagataagtttttatcggatattaaggaagtcttgaagaaaaaacgctgtgtcgtaattgctgttagcgaaggtatcaaagataaggatggtcattttttagatgatgattccaaatatgctaaaaaagacgcatttggccatgtgctgcattcaggaactggaaaaatgctggaatcattagtatttaaagaattccaatgcaaagtcagaagcattgaattaaatgttttacagcgctgtgctatgcatattggcagcaaaactgatttaaatgaatcatttgttatcgggcaaaaagcaattgaaacagccctagctgggaaatctggtcaagtaatgggatttaaacgaatctcaaataatccatatgaaatcgactatatttctacagatgttgcaaaggttgccaatcttgaacaaaaaatcccaactaactggatcagtgaaaacggcaatgatgtcagcccagaattatatgattatcttttccctttgatccagggtgaagttcatattaattatcaaaatggaattcctgcttattacagttgtaaacatctaaactaaaagaaaggggctgtaacgagtaaataaatatggaataatttcctaactacgcaaaaagcgctcatacgagcgctttttttggtataatttagttaatgaaaccatatatatacaaatcagattataacgcatatcaaccatatatgctactggattttaacatatcttttgaaaaagatattcctcatgatgatatttgtagaactgttttagaagttacggaagggatcaatttatgtaaatatgttgacttctcaaatagaaattctcatgggtatgatgctgttatgatgtttaaccttgttattcttgctaaagctctttttggctatgcttctaccagacaccttgaaagactctgtcaaaccgatattagatttatgtttattgctaaaaatcaaaaaccatcccatcagtcatttcaaaggtttattcatgatgatttaactatgaatattgaagatattttttatgatgtaaacaggtatctccaattaaacatggatatcaatactgatgttttgtgtatcgatggtactaaatatgaggccaatgctaataagaatacttttatttggcgtgccaacacaataagatatcggacgaacagatggaagaaaacacttaactgtattcataaaataaataattacttctctggtgtaaatataacagcccgctattcattattaaaagaaccaagtattgattaccttttatccatcagtgaaaaattagaaaaatatatgctggatgaaaatatacaaatggttcatggaaaaggatgtagaaaagcacctgttcaaaaactatatgatgaattaaaggacaatgctttgaaactgtgggaatatgctatgcatatggatatgttaggcaatcgcaacagctgctctaaaacggatcctgatgcagcttttatgcatatgaaatatgattactataatcacactaatgtgtttaaaccgggatataatatccagtttgggatcagtgatggaattattagaaatatttatataagcagtgacggcaatgatttgagaacatatataccatttatggaaaaatataagaaagcctatggaagcattcctaaaaagacaccggctgatgccggctatggaagttatgataattacagctactgtaaagaaaataatattgaactgtatatgaagtattcgggttattacaaagaaaaagaaaaagtcacagataagaaccggtttaaatcagttcacttcaccaaaaatgaagaaggagattttatctgcccagcgggatatgctttcgaactggaaaaagagacagaagattcacgaggcgtgtatccaagaattaataagcattatataaacagacactgtgccgtctgtccattaaaaagtaaatgcacaaaagccaaaaatggacgaacaattgtgaattgtgataaactcgaagagtatcaccaggaagtaaaaaagaatgttacaagtgatgaaggtatcaggttaatgatgaaaaggagcaatgaatcaaaaggtacttttggtgatttaaaatacaaccagaaatatgacagactgcgtcgtcgaggagaatcaggtgtaaaattagagatatatctaatagccataggagaaaacctgagaaaatatcatcgctataaaataaaaaaatcagaagaagaacagcgaaatcaaatgaattagttaaaaattttttataacagaaggagttctttttaagtgcgtcaaaaaataataaacgaatgagaaaagtataatacagattgactatatttttctaattcgttttaattttaaaaaaaagagctgtaacgctctaaaatagctgaaatactatttattcgttacaaccccttatttcttgtgatttttagttcttttaactatttcactagcatctctcaatggcttagtgattttccatgaccgggaattttccataaaagaaattctgtttttagcttctattaaagtgtttttagtatcatttaactgtttatctaatttattaacttcatccatgacaatgctaatattagcgtacatatctaaacaataaaatgatatctttatcgtttgataatatttatcatttaaattaattaaaatttgcggatcatattgagttaaataaattgcatcatccacttcacggcctactattactgtataaggtactgtttcatgatcaagctgcactttaaagtcttttaaaatccattttccaatttcatcaggatcaaagcgaatatttttagcaccttttggtatatctatttcaaatgatattatttcgtttgtaacctcataatcttttgtgacttttgcctgttctgtaaagccatccccaaaatcaaaataaaactcagctgtagcgtttaatgtatattggtataaaggggatacattaggaaagaagtatttgcctacttcttttcctgaatctttaatattgttttcaagcaaattattcatttcagcaaatagtctctttgacgaatttccatcaatatgactatggaataaccccattttttcatttctgatattagaaaaatcatctttcccctggaaaatttcttcaattttttcaattaaaccctcttggttttttacaattactccaggcattagatcttcaggatcatcaacaacaaatccacggtcttctttatatttcaataaatcaggacaagagaaaataattggtttattcaataataaataatcaacataaactgatgaataatcagttatcaaaatatcaaaagcattcataatatgatatatcgttaaaagatgactattaagtatatcagtgtctaaaaagataacgcgttttggtaatttgaaattgcctttagtataatattcattatcagcaaaatgtaattttgcaaatatgtatgtattttgcctttctaaaaattcatctatcttatcaggggcatagtcataataattaaatatattattatcaaactgaactccttcatcttttaaaccttttctcattgttggtaaatatagaataagtttgctattttgaatatcgatattagtgatttttttcaattcttcttttccattataattaaagataagatcatttcttggaaaaccagtctcctttacttttcttggatcaacagcaaacatcccacttattgttaatcgtgataatctagatgtagctgttattaaatcactttgggtcgtaataacttttaaatttttaaaagcctcttgattatttgaagtcgaagcactatcaaaaaaaccaatcaatttaagcggaaatccatgccaagctgcaatatgaatttgttggttactttttaagtaggcaaattcaaaagatgatgttattaaaacttttgcctgagcaatcatctcattagtatcagaggtattaattaaaccacaatttatatttgatttcttcaacgaatctaacatttttggttctttaataacccaaaatgtttcataattagtattctttgcaatatattcccaaaatccccttgagttatctgaaaaatctgggttcgattcaaatacaattaaattattattaatttttctattcaccagtatatctcctatcatattttattatctcaataaaataaccatttacctctatatatttcaatataattattgtgatctttctacaatacctaccccaacttctattaattttaaaatatgttatctaactttttattgtgatttaatagcaacttttttcaaatcaatcacattatcgttttgaacattgacacgatataatgttttactactgatttcatcagtagaactaaataacttagaagaattttctataaaattttggtttattttatctagatagacataatcgtactcacttattgtctttttaagatgttcggtatcaatattattttcctcaaattgaatattaacgccatcttcataattattttgtattctaataggtgttaaataatactttgtgctccaataatcaaatccattagtatcattacaaatataaaaaacattagcatcactaggaacattttcgataacattttctaaatcttgaaaataggtgttataaaaatcttttttatcagattccccaaatgttgctgccttaatcgaattataaaatggtacaactccaattgacataaccgataaacatataactattaacattggggcttttgaaataaacttattattcatatccaaatccaaaactaccataaataacattaaaaatgttgataataatattgtgagcatatatctcccaaacgatgctaattgcatcgcttcttcaaacccaaataagaacatataagaaaacagtattcctaatatatatactccaccagcaactaaaatagctaaggttaataaatttagttgcttgcttaatttttttcttactttgtaagtacatacaaatgcaattaaggaaaaaaatactatatagtaatatgtcggccaaaataaaattccacttcctactcctatcccattaaccgttgatgtacttacatacatattaattaagtcttttgcatattcaggaattttaaaacttactttacttatattttcatatgaaattgtaaattgggtaatatagtatctccatgataaaaacattaatattggtaaacaaactaatactataaattcaattatcaatacaggcttattttttaattttttaaaataagctatatatgctgatctacgaattattaacatatcgatgactataattataaatactgctccaaccattattattgaaaattcttttactagcaatattgaacaagtataaattgatataacataaaaatcaaatcgagtaaaactatttctaattacctgatatattattaaggcaagaaatatacctaatattgcatctacatatatagtagaaaaataatccgtaaaaaatacaaaaggaatcacaaagactaataatatatataatccactctttacgaatttgccttttaacttatcatggttaattattggacaaaacgccattgaagagaaaactaataatgaccaatacaataccggttcactatacgcataactcaatttcatacatgcgtattgaagaacactaacaaaagggggataagcaattaaatctgtgaatccattacttcttaaagcatcaaaaacatacatgttttttacacacgttgcccaatgtgagaattcatcccataagtgaacataagaattcatacttacaaaataacaaataaaaactattaggattacatatatgattaccattctaaaaactagctttttaactatattgctattttttttatactctagaaaaaaatatactcctccaccaaatattaatatataacttaatatatttaaaattgaaaataagttgaacaaacctaatatatatacccctaacacataaatacaagccgatacaaatatagttttttctatttctcttttaaacctaatagatataaatgtagctattgataaaactgttaaagcaaatgtaattacacccattaaaaatttcgtatgttacatatttaatttgtaataagtaacatacatactcctttccctttatttgataacttataaaatttatttttttataagtttagtaaatatttaaaagactatttatatagtcttttatcctaaaaattgtttatttatcatcttttatgcccatagtcattcagataaaatcatcaatacataactctataaatatacaaaccatcttcataatattctttttcaaaagatatcatgtcgttactatactctgatagatcagacacacttataatataattaatatcaatatcctttacttgatcaacatttaaatcaagaccaacatgatcattagaaattaatttaatgtccgttttttgcaaagataaattaattgatagatgtccataacgattatatacattatcaaattctttttctggatctaatctattccataattcaaaattaggataataattagttgaattgatcatatatgcaccagttgctgctatatagttttgaatataataaggtgttgagacacacatccatctagccgttttatctttagcaataattttttcaacttcttttactacgggcttatcataaaatacattcaatcccttatttaaaggttgtaccatgaccccacttacaaagatgatcggtataaatactaacgctaacatcttattcaacttgtgattgttgacaataatcgccataaatataaacaagaataataaaattgataggatagttactttagttgaaaagtattcaggataaattggtgtaagctgcttaattgaatatacaataaaggtcccacttataaccgtacccactccaatgatcaccttatttttttgtgtataatgggtatattttgataaacagataatcaagattattacattaatatatcctaatgtaatatttgctcttgaaacagttgacattgatattaaagtaattttagcgatgatttcgggaattggtaagaaattccaaatgcttaacaatattgataggatcactaatccatttaataaaaagtcattgtttttatttttatagtttttaaaaccataataaattcccattattgttggtaatggataaaaagatatgaattgagacatttcacaagcattattaacaatcttcattggtaagaataaatttgagaaatatttgattatatcaatctgtccatcaccgcctgtcgttaaacgggccccaggataaactgtgtttgtgattaaatcataggtttctttaccatttaaaaaggctggaactaaagttattgcaattacaaaaacagctattacaattaataataaaatatctttaagttttatacttgttcgataagtaaaaattagccagcacactatgactaagaagaaataaccatagggaattaaccaagctgggtacatgttcatgatataaatactgccaaaatacccaattaaagctgaaaaaattattttttgttttaaattttttgattttaaaaaggcattaaataccactaaggccgcctctccagaagcaatgatcatataagcataccaccactgtgttgccggcgcaaaggtaatcatcaacgcgcccataccggaccagagcttattttgttttgttagaatcatcaaaaattcaaatgttgcaaaaaacataaagaagattggtaaataccaatacatcgaaaaagcattttctaccggtaaaactaaaaaacctaattgctgtggtaccgaaaacgaagcactatcaaacgtcggataacgtaaataaaaggacactgatttatcttgcgccattagattgtgattagtactgctaagttcattggcaggacttacttgagataagacaaaaggggtagaaaccgcatattcatcgcctctaataaccctattttcacctaaaatcggattcccgttttctactgggatactaccctgaatagcaccattataaattcctacactagagccgtgataaccaccgattactaaaaaggcaaaaataacgatcccaattaaatatctttttttatacacttgattccaaatatcttttactttgaagataaaatgaatccccataaataacataattacaaaataaattataaatctatcgactgaaaaaggctgtaaatcaaaataaaatttttctataagtatcggcactaataccgatagcattagtacaagaataatttttattatattttttcgatccttaagcatttattcgaccctttttgcctttcttgtaatctcgatagcctttatacatataccataactttttaattttctgtttctcaaataatattattcgtttaacttctgccttagtacatcttatttcagcatcgcaataatcaggaaaatcattcttatattcatcatatatataatgtctgtttctaacaatatagtaacggcgaatatgactatgattatcgcagaaatatgtttttgaaaataatttctttttaactgtatctcctaattcatgaagtaatattgctttatttacttgatgaatttcatatttgtttctaaccagatttaaacaataatcaaaatcaacacagtcaataaaataccaatctttaaaaccatttatctttttataagcatttagattaattaaattaccagaagtcataacaataattggtttatcaacagactcactatcgggtctgttaccaccactcaaaactgtttcatgaaacggtgatacgatcgctatattttgattttgatcaaaatttgtctcaatatactcttctaagtataataacgactcgtctttaaattgactatcttgatccattgtcaatagccaagaaaaaccatcatcaattgcttttctcgcggcaatatttaaacctgcagcaattcctaaatttcctttattccatacatactcaattttattatcaatatttgtaaataatccctggttatcgatagatgaattatcaattaaatatagcttatctatgtattttaaatacgaattgatatttttgataacatccttttgatccggattaaataatattaccgtacctgcatattgcatcaattctcctccattatttaattagtttttttgcaattttcttcattggttctggcagctggattcttgacactaacttccatcttcgggaatttaatatctcttccatattagcataatgtggattaatgctttcatttgtttgactatcaattagtttactaaccatgttgttatcatgatcgttacttacattatatattggtaaatattgactaatcatatcatttattgttttaatccgataagaattcaaagcatcgattacctttttataagcatcttgatcattttttaaattaactatatattttcctaatgcttcattgcttatatctaaaggtaccgtccaaccaaaaccatatttttcaattctttcagctacagcaccaatattgtaactcaatactggtacaccacatgatatcgtctcacttaaagtataagaatatgtttcgggccagattgataaattacaaacaagattaatattattatcagctagtaattgcggcagctgttctcttttatacttaccatggaagatataatttttcgtattatttgtcaatgacttatactcagagtcaccaaataaatgaaaagaaatattagaatccttaatattttttataagtgactcaacaacttctgcacctttatgtttagccatgacacctacaaaagcaatattcattttattatcactcatcaatttcccttgacgttgtttgatatttattccatgttcgatatcttgacattggatatttgaaaattcactttcaagaatatcttttgttgatttagatggtgttaaaataacatcgatcttgcctaaaaaagcttcccatcttgatttccataaatctaccacattattagcgatccccattttgtttttcaaacattgagcacaatcttttttatctaaatataaacaacatttttccatattatagagcatattgatacttggacataaacaataaaaatcatgagcggtataaatggttttaatattgcgacttttagcagcatcaacaatatcaaaataatgtcccatcatatgatgaatgtgaataacatcaatatctaggccatcaattattttctctactaatttcttatattctttactataaagattcgttcgacttacattattataaatgccatcaaatttcagttcttcgctatcatccttaaaataagaatatactttatataatcctccttctggagcaagtacatgaatattgtaatcatttcttaaagattgaattaaatcatagcaatgcaaagtcgtaccgccaacattttcattaatatttgaccaatcatgaacaacaaaaagaatatttttccgttcatattgattaatcaaatacttcacactcaaacaagtattctttaggggaaaattctttaaccacaaatcggtcttactaacataggctggatatcttttagctaatattttcaagttattctcaatcaattctgtttttgattcgctaaatgattggctttccttatgatagacaattacatcatcacataataaatgcttataaccataatccatacagcgataagaaaaatcattttcttccccgtatcctttgccaaaagcttgatcatcgaaatagccaacattatttaaagcatcgcgtttaatatacatacaaaaaccatgggccgttggtagctctggatattttcttaatgaatccttttcgataagttttgcatattgctcaaaactcatgttatctggcaattcattagcttgaagtcccgttggaacagatactaacgtcgcattattcgaaagcggcgtaactgatccaacattttcttgggagtaagcacattttttcattgattccaaccagttaggtggaacttcagtatcactgtttaataataaaacatcattttttgaatacttcattcctttattaacagttccaacaaagcccaaatttacatcattatataaaataataatattattattggttgtttctttttctaattcctgtaaatactctttaactttaggatctggacttttatcatcaattagtattaacccattttcttctagatcagtattcttgataacagtattgatacattcttttacacaatcaattgcattatatatggggataataatatcacaacgcatcggtttttctcctcttctttattttactatacttgttcagcaaatcccttttctaattttttaaatatcttatatccaataaaacaaacaacaactgacatcacaactaaaattagcattatcttgatatctggtactgtatgatacataaaagcattacgataagcatctaagatatgagtcattggatttaaatttaataccttttgaaataattctggtaaagttgatggtaaatataaaattggggttgcataaaaagccatatttaatacaaattgaataatatattcagtatcttggatataaatattgatagcacttaaggcaaacaccaaacctaatgtgaagaaaaactgaatcaaggcaataaatggcactaggataatatgccaagataaccctactcccgaaaacaaacagaatagaattataatcaaacatgaaataaagaaattaactagcccacttaacactaccgaaataggtaagatttctcttggaaaatatacctttttaattattccagcattagcctttactgttgtcattccttgaatcatcgtggttaaaaagaaattccagggaatgattcccgtcacaacaaaaatcaaataattatccatttgatttttcatgatgatcgaaaagacgatcgtatatactatagtctgcaataaaggattaataaatgaccataaaactcctaaaaaagaacctttatattttcctctaatttctttttttacatttgatttcagtaattctcgataattgtacaaatcattaactaatttcatataatcttctccaaaaactattccttagagaaatccacctcctttttagcaatttctatacctgctatatctaccaaaattgctttgatatgatgatctccacaatttatattatctatattaatagaccatccaatctcatcaggaattaaatcctgacaatctttcttataggtctcgtatacatcattacgtggtctatatgtaatctgatcaatctcttgattatctaaatacacttttaactctgttccagctatatcgctaattttccatcctgatatttgtagattattactattattaataatttcaaatgatctaggactttcaataaaaataactgatttagattgaatatctaaatcctccatttttatttcaccctttttaaaagcttctctttgctgcttcaaatactcattaattacatatgcaggatcaccatctaaacgaaattcacctttatataaccagattgcccgagtacataagtccttaattacattcaaactatgtgacactataacgatagttcgatcagtatctcgcagctcttttaattttgcaaaacatttttcttgaaaatgctggtcaccaaccgctaagatttcatcaatcaataaaatttccgcatctacatttatagcaatagaaaaagctaatcgcatgtacatcccagatgaataggttctaactggattatcgataaattcctccaactccgaaaactcaattatttcatctatccttctatctatttcttttctacttagtccaaaaattgaagcattgaaataaatattttctctaccggtaaaatcgggatgaaaccctgctcctaactctaataaagaagttaattttccattagtctctaatgtccctttttctggatataaaatttgggtcataagttttaacaatgttgatttcccactaccgtttgttcctatcagcgccaccgtttctcctttttttatatctatatttatatttttcaaaacttgatgatattcaatatctttctttttaaatattgataccagtctttcttttaatgttgctggtttatcatactgtactttaaattttttatataaatttcttacttctatagcattctccgctttcataattcctcctattttatataccagtctaaacattcgtataatagcatggaaataactattaatcaacaaccgccatataattatggtatctagcaataaaaataaacctagtgcttataataaaaaaatctcttaatcattatacaacaattaagaaatttttactattatgattattcttcataccagcaatttatatcaacagaagttgatattcctggaacataaccacttgaagtgtattgccagccctttacgccattataatatggattattaaatcctaagctgtctgtataggcagccacccaagaaacatgtttccagattttaggattatttaagacactatttaagtatgaacgataactataaacttttgcatcaaagccataagaatttattctatcaacaaactgctctacaatatctacatattgttgagcggttgccgtagcgtactcaccttctagatctaagaaaacaggataagctaagtcattaggagtaatgcctcttttatttagcgtgttaattacataattggcttcttctaacgcctgattaccatttccagcataactataaatgtatagtcctactggtatccctaatcgtttacactcagaataatttttccaaaaatatggatcctcttctagtttctgaccattttttattctgataataactccatctacatcgccactatcttttactgtttgccaatcaatatcataattccatttgctcacatcgatcacttttttagatggtccatttcccaccaattggccatagccatcataaaaatacttatgattggcatcctctaaccatccgcttttagcactactatttttaacattttgaattggtgtaatcactgaagctaagttaccttctccatcataagcataaattgccgtcttgtatgcaccatattcaaaattatgttggctccggttaacacgataggtaacggtattgccttcaattttccccggttgccagaccatatcatcttgaccaccatacattgtccaggttccaaataatacttgcgagatatttttattactttcaacctgacaagtaatagtatatccatcttcatttaaatcactaatataaacatcatatataagcggaatactatagtttgatggcttttcaatctttattccattattagcatgaatagacaatccatcttcctcatcataagcataaatatgggtattataagtgccatactcaaagttatgattgtcccgactcactgtataggttacggtatccccatcaattgtccctggttgccaaatcatatcgtcttgaccatttttcgttgtccaggtcccaaaaagaactcgatcaactttcaaatcatcagtaactttacattctattttatatgaagtcgaagtgatatctttaactactacattgcttatttgaggtgctttattttgggctggaatattggttacatacgctcccgtcgttgtcaacagcccttcattatcataagcatataatactgtccggtattctccgctctctttattatgatcgctagttttgaccgtatacgttactgtattgccgctgatcgttcctggctgccagaccatatcatcctgaccgttcttcgttgtccaggttccaaaaagcactttatctaattttgtatcatctgttactgtcgccgttacggtatacccatttttagttacattgctgatcttgacgttactgatttttggggcttcatttacttttggcacattggttacataagctcccgtcgttgtcaacagcccttcattatcataagcatataatactgtccggtattctccgctctctttattatgatcgctagtcttgaccgtatacgttactgtattgccgctgatcgttcctggctgccagaccatatcatcctgaccgttttttgttgtccaggttccaaaaagtactttatctaattttgtatcatctgttactgtcgccgttacggtatacccatttttagttacattgctgatcttgacgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagtactttatctaattttgtatcatctgttactgtcgccgttacggtatacccatttttagttacattgctgatcttaacattactgattttgggtgcttcattggctggttgacttatttcaccaaacatttttatattttctttatttacatagccgtacatactactaaaatcgtagttggcactacttgaatcaatattagttctcgttgaatttaagactgcatcagactggactttataataatctcctcttgcttcttttactataaaagcaacattgctcattccttttatatcgaatattttattattagtattggcatcggtgtatacactgcttgttgagggtgatgaatttatggtatttttgattccaatagtatatttattagcatctttttcgccagatgaattatctaatgtcatcatcgttgcggccgctttttctccccaataaggatcagaggcatattttacattcattccgctacctttatcaccaaagtaactcccgttatagttggagctgttagggttacaataacccttggaaactagatttgaggcataatactcaacacatgcatcaacagattcataagtagaggcattttcatatgggttgctgtcagttgcgttgatcccaaataaattatttttatcaagagcaattcgactagttccccatgatgattcatggattgctaatgacaagatcatcaaggcattagttccatattggttttgtttaaaaattaatgtttcgccaatgttttttagttttgatggggtattagctaaagccacagtactgccattataattaatcttcttggtatttaaataattattaatatcgctggccgtataattagtggtgcttctatatggtaaatactgaaagtagttatagtatggtgaatccggattaactgaattgtttcgtgttccagctttatagtcagaaatcatcttgttataatcattataaaaataatgaccatcgtaactataatactgaatccctttttttatgtatgatggggcctttcctactgcgttataattggcggactgcccatttgaatttccaacagcatttaaattattggaaatataatggaataattctcctttactatttacttcataattactcacataataatttccggcatttactacttgtacttttgattgatcaactaaaccgatgaccccagccatcataaacttcacttttccgttttccattcctagataagcagcatctgcagcactagccttagagatatatcccgtttttccgctataatagtctacatatgtcgttgttgttccagcgccgatataattgaaatttactacattattaacagatgtttgagcccgactttggattactgttccatcggtaacatctataactttgatattaccctcttcatcaacaaattgggtttgtccaattatatttctattattagatgtctttgacgtgttgttatctatattttctaagccattagcttcattattggtttcattagtttcgactggctcttgttgcgattcttcttgaatatctaagccattaatttgacttaaattaccaactgtaaaaccaactgtaattaaagatgccaatcctgttttcataatttttttgctcattccctcatcctcactttcttatattttttatcatactaagtatacaaaaaacaacgctatattacaaataattataatgatttcttttagattaagatagccattttaaataaaaagaagtataaaagcgtagaatctatcaataaatttgatgattttctatacttatatacttctttaaatagaacttatacaaaggattcaaataaaacattttgtcataataaaatataccgataacacaattaatattggcacagtatctaaaagtttctcactatgattacctctattaccacttttagaaaaacatagtgtcattaaataagcaattggaataaaatatcttccttgaactccctctattgtaggataatctattggagtattagcaatcgccattgctgtcatcgttgccaaaacaataattccaacaattattatataaatgaacttatgttttttagaaattaaagaaaaattatcttcaaaatatgaaatcaatattgttaaaaggatccaagcaccagtgagaataactggaatatcgatacttaaccaaaataaattagaaccaaccatcgaaaacagatatataaaaccatatctaaatagcgtttccccatataaaaaacaagctttaaagggattggcaatcatccacgagatactgtacgatggtgttcctgaccagtttacaacactatttgataaatttgatatctcgttgttatgagctggactaataatggtattgtagttaattattaaaaagaatactacacaagctaaaatggcgatagctttttgtttcttttctaatcgtcctagctgaccatatcgcactaaaataggtattaaagatattaccgcatatacggaacctttattcgaaaataaaagaaaagtagctatcaagtataaaataatatcattaggcctaatggttttactcgcatagaccatttttaaactacacgcaatacttaaaaatgccatcgagttgataattacatcataggagtatgacatcatttgctgacaagccattggaaacaacgcaatcataaacatcggtttcttcataaatggtaatttttttatcgcaatatatacaacaaatatataaaaaattagacttgccattctccctagatagattgtagtaatcgcatctaacccaatcaatctagacatcgttaccataactactgctgggaaataaccagttatattagtcaagcttgttgaatcaacaccagtttgaatatagttcccagaacgttgggaaattgaatttgaatatagcattacatatctatcgttgcttatttcctcagtttgaaaacaaatataattgtattcatcttctcgtaaaactaatttaccttctttttcaattcccattagttggctggatattgaataagtagtctgcatgtgataccactcgtctggaacaattcctggaggcaccagcaacatatagataaatccaataggtaaggcaatgtagagaaatattttttctatgtctacattatactttcttgaaatataaaaaatcacaacaacaataagtaataatatatacactaaattaataacattttttatctctggagctatctgggcggtattagagcatgtggtcttatatagaaaagccaataaaagtaagactataattattgaccatttattacttttttcacttgtttttttatgcctcattattagtaatcacccgtattctcttttggcagtttattttaattacactgctgtatcaaatttataatgatccttttccataaactacactttttactgttttatacataattgtaaaatctagccaaattgaccaattatgataataataatcatctaatttgcaacgataactgaattcaacatcacttcttccgttagcttgccacattcccgtaactcctggttttagttttattattgaatcgtaatattgacccatgtcttctttttctcgaggaagatatggccgtggtccaataaaactcatctcaccttttaaaacatttacaaactgaggccattcatctaaagaagtttttcttaaaaaatgtcctactggcgttattctcggatcatttttcagctttttattcgttaaatattcttcccttattttaggatcatcagccatcattttttcaagtactgcttcagcattcggaatcattgatctaaatttataaattttaataagttttccatttttaccgattcgttcttgcgaaaacataatattatcatggtcaccacttttaatgtatttatatttaacatagaacatcaatggcagtaatgttacaattcctgctaacccagctaaaatatcaataaatcgtttaaagaatttatctaataaactcatttcatcatttgatgtggcaattagtaattgaccatcaaaatcttgaacttccgaagaaaatgtcattgttccatttacatcaggcaaatactttactgactctactttaccataaatatcactcattactttgtcaattacttgttgattagcttctgggatagcaataataatttgttctatttttaaattacttatcgcttcaccaattttttcataactataaacgggactatgtttaataacattttcttgtttaaagctaaataacgaatcagtgttattaacatttacatatcccattatattagttaaagcaaacctattattatttgatatcttacctaatcgagcggcttcgtacccagttccaataacaagcgtttttctagcgaattgatctctaaaagcaattcttaaaaatcgcgatgctaataaactaattaaaaacatagaaattgccattagggtcaaatgcatctttctttcatatcctgtagattggggtactaaaactaataaagctatgtaaaaacaaaaacttgatttgacaagctgttgaatttcattccatattaaacaagtatttaatgaataatgtccgtaaataaataaaaataaaaaatatagcgttcctgatcccactattaaatcaatatccatatgaaaatataagcatataaaataatacatcacaacctcaatcataaataacatgattggcattatttttctattcataattccacctcgacattcatagaacaattataccttaatacaactattatttctatcttttatcagtttaaacaactaataagattgtttaaactgataaatattgtataataattatatactttataggaggttgtccatgaaattcttttatacgggattaaataaatttatgtggaatcacccatttatcaaatcttgtactcattttacttcaagattttgtccatacatggttgctattttttatatgctctttttattaaaaatatatttagatcgaccacacaacctattaggtttagcggcagaaccaatagcagtatttgcaattaccgctattttaagaattgtaattgatagaaaacgcccctctgaaaaatatgatttgacaccaattgacggcagtaaaaaaacgggtcattcatttccaagtattcatgttgctatgtcaatatcaattgctttagctgttttacactctggtcctaatatgggattgctattaagtacccttgcaatagctatctcattatgtagacttttatcaggtgttcactacttaactgatattcttgcaagtattgctattgcttttatagttaatttaatttaataactttttaatcacaagataaaaagggattctaaaataacatgaggtagcactagtttagagctataaaaatacatgatgtgataacgacctcatgaatgtttagagatcctgattatatgccatcccactacgggatggcattaattatataatctcataaagctgttttatcccataggaaatagttaacgaatctatcctgttttttaaaacctgatagattttttcgtaattgtaattaatatctgatggactggctaaacttacaccaggattattatctggtaaaagtatccagtatccaaaatcacttcttcctatgtatgatgcaaaagaacttcctcgtccctcgaagcagcggtagtaacagctttgataactaattatatgtttgattgtccctgtccagtgaatcttcctgtttgtacagttataatttatattgttcatcatcatattctcctttgggatacatgtgataagttgcgtctttattcactacatataggactcgattacggaatcttttccagctggtatagccattgctgtttcgtttgattgttttgattgtcttattaatactttcaatggctccactggttactgttgcgccgttggatgatggtttaaatgaattgataatacttttcttccacttaattaaagtactggcgtattcctgcatttctttaatattgctggtatttaattctaagatgagtgtatttagcagtttagctgcactgttgaatttagcctgtttaaagaaactggataattcatctttgaaatacactgctgtttccagttcgggattgatattaataatttcttctcttatatcgtaataattaacatatttttctagaacgcgattatattttttggctctgttggggtcaaataatttttcatcgccggtaaagagtagaaaatcaaattttttgagtatgtaatatttctgattgcgttcttttaattttaataattcttcttcagttaactcttctttttttatatttttaggtattttatattgattcatggtgttgattctaattcgattcattttttttgaatattcctgaagcagatgaaatttatctaccgtgtgacagctgttaggaaataccagtttactaacgttgcgatacgtttcccacatgtccgtgcatacagtttttacgttttctctttcctctctgggaatcaaagtaaaatagttaattaagtcagctttctttctgctgggtaatatgtcgattatatcatgagttttaaaatccaacagaacacatacataattactgtcatcagatttaaacccatacacttcatcaatcagaatgacttcaggaagtttttttctggatatgtgaacatgtctgtcaaatatgtttacaacggtagtaggtgatacgtagtatctcttagctgctgagtgaaatgtttcgttaggcagtttgagatcatttaatacattatatacggtcattaaagatactttcatgcctttgaaagtgaaaggattgttttcataaaaagttttgttgcagcagggacatttataccgccgggcatgatactttatataacagggaacgtgatttaaaactgaatgggttattgctctggttacataattattgactttagcagtagctgtgccacaaaccgggcaggctgttggtctgggctccagggtgacttctaagttaatacctttgtatgaatgatgaatatttacagacttaatatctttatcattcaaattaaacagttccagtacgttgagctcttttaagggcatagaatccctatcggttttcatgatgatcaccaccagtcatgataatattagttaaaataatgttgttcatttgataattcctcctgtttttgttttacagggaaataatagtataaatcatcaaaattaatcataaaggataagtgaaaatacaaaaaaattacgtttgtttagtgaacaaaaggtataatagtttttattaatatttttgtatttagaatatatgtaataataatcaggatcctgagtttcaggttccaataaaaaaataatatcctcaaaagataatgaactgtaaggaatcatgtcttctataaggactgcatgagtatgatgacagtcattacaaattacacgagtgattagtatttttatcttacagccaaaaaatctacagatcttttataacatgaatgatacgaccagttatgattatggcagtgaggacattcaacattattaagatttatagattttatatgattattgtaaactttttgagaaataggattgaattttgtattgaaatttagtattatcatattgttcgatgaacaggatattaatcaaactttggttggggagattattatccttttttctttctacaggataatactattataatataaaaaagggacaaaataaattttgtccacggggtgattaatcactacagatgattatcacctttttttgttttatataaaacaaaaaaaggtgataatcatctgtagtgattaatcaccccgtggacaaaatttattttgtcccttttttataaaaataaaatcatattgaaagggtagatgatcttatttatttaataatttatttaatagaccggcacgattattaataaagagttctgttatttgataactctcagtatcttgataatcaataggtattatctcttttgagtcaaaattaagtatttttgccccagggattcctaataggatcggtgaatgactagcaataataaactgtgagccctgctttgctaattcataaatagtaattaataaagttagctggcgctggggtgataatgaggcttcaggttcgtcaagaatatatagactattctgattaaaacgattttgaatcaatgttaaaaaactttcactatgtgattgctggtgtaatgatttaccaccataatagcgatagggattaaaaacatttttttcatatcattctaattgtgttgcgacattataaaaactttctgcccttaaaaagaagccttcatcaggacgacgataaccacgatcaaggattattgcatgatgcaaagatgaatgagtattgttagtgtgaaaattaaagttcaaagttcccccctcagggttaaagccatatttaatagcgattgcttctaataaagtggattttcctgtgccgttttctccaacaaaaaaggtaatcggattatcaaaaatcaaagtatttaattgtagcaattgtatttagataactgtttcgctcgattaaatcatgatcaatagttatacgatttataaaataggtactcatttcatcacctctagtttaatcataatacaatttattgtgataatctatttttaattaatagatagtacatattttaatgatataataaaagaataaataaaggtgggaggatatattatgaagattgatcggacatatgcaatttatttttcaccaacttacacttccaagaagtcagctgttagtattgctcgtggacttgagggagagttaagtgaaattgatttaacactagaagaaacgattccagagatgacatttagtcgtcatgatattgtagtttttggttttccggtttacggtggaagaattcttcacgaggctttggaacggttaaaatcatttcggggtgatcatacatcatgtgtaattactgttacatatggaaaccgtcattatgatgatgcattattagaattatttaatactgttaaggagcaaggatttattcctattgctggtgcagctttagtgggtgaacatacttatggtcaaattcaagtgggtcgtcctaatcgtgatgacttatatcgtgatgaattgtttggtagtttggtgcggctaaaaattaaagatgataatttttcatttgtttcagtaccagggaaatacccatataaagaaggaggaactgggggaaaatttcgcccagaaactaatgaacagtgcagcggctgtggggtttgcgtcaatatgtgtcctacaaatgctattgatatagaagattgtaagacaattaataatgattgtattgcttgttttagatgtattcgtatttgcccagtccatgctaagagtatgaataacaatcaagaatatcaaacatttgcagaaagttttagcaagaaactggcaacacctagggaaaatgaatactttatttaaatttttgagttttttattaagctttaagagattttaaaatgtcagaaagataggcttttatgaaactggtgagaaaattattttcttgctagtttttctatttgtaatctatgtataatatatctatgaagattagacggaggaaataataatgaaaaaattaaattggggaattattggcagtggtgtaattgctaatgaaatggctcaggctttgttggatgtaaatggggagatatatgcggttggacatcgtgatatgaataaagcaattgattttgcaatgaaatataaaattaaaaatgcttatggaagtgttgaggaattattaaatgatcctgatgttgatgttgtttatattgcaacaccccataatagtcattatgaaatcatgaaacaggctgtagcagtgaaaaagcatgttttatgtgaaaaagcaattactgtaaatgatcgtcaattggaagaaattgttgctttagctaagaaaaataatgttgttgtacaagaggctatgacaattttccatatgccgctatacaaaaaattaaaggaaatggttgctgcaggagtaattggaaatgtaaaaatgattcaagtcaattttggcagctgtaaagaatatgatgttaataatcgtttcttttcaaaagaattagctggtggggcattattagatattggtgtttatgcaacaagttttgcccggtactttttatcatcaaaacctaatgttgtaattacaactgctgattattttgaaactggggttgatgaacaatcaggaatcattatgaaaaatcaagatggtcaaatggttgtaatggctctaacaatgcgtgcaaaacaaccgaagcgtggggtcatatcaggagaattggggtatatagaaattaataattatccgcggagtaatcaagcaacgataacttatactaaagatggtcatcaggaagtcattgaatgtggtgatgataaacagggactacaatacgaagttattgatatgcaagattatattataaataatcttggtgaatatgaattacagttaactcgggatgtaagttcactgctaagtcaaattcggactcaatggggaatgatttatccatttgaataatttaacatttaagaggggatgatgattaagaattattatgcatgattagtgtactgatttttgctgatattttcattgttacatttattagtgtggcacttcaacatcaaatgaaagctctaaaaatatatcgacttataaaaaacaattgttagttttagatagcagtgataatttttggaatgaggaacgaataaaaaaagtagaaaatcgttattatgcgatttaaatgtcatggtcaaatcaagatcatgaaacattaaaagattatttgtccccacattgttagaaaaatgggaaactaagaaggaacgtataaaaaagattaaattattggatatggttgttgaactatacgatagaaaatgataatgaggattgtttgtgggcttatattgaggagaaaatagagtaattacgtgtgaaacaaaagcttttgtagaatactggaaatttataagaaatagtaataatatatgtttagataagtttgaaaattgattggaaagaattgttatgaaaagttcaaatcaaaatttgaatatagtaatagggtgtttgaaaaggtgctatttaattataaaatttatcaattttgtataagtagtcttgggaaaactgtgagcaggatagttttatgatatattatttaaattttgaataataaagaatagacgtgtgaaatattcgcacgtctatttatatagatttggtttgattattttgttatgaatgatgcgttcaatatattcgtatacagtaatactgcgatcgttcattgctaaaactaaatggtagggatctttaaagtcttttacatgacttttaagaagattagctaactcaataatatgctcattatttgaagttaaatctgttttaataaccatctgttcattaatcttaaaataaattggatgagcgacttcacttccaaatgagtgtattctaaatgtttgattataccatccaatttcacattttttaatatccttaaaggcaattttatcttgatacatttctttattaaaaagcgtattaataattaatttaaggatattaaaataacttgttgatttataataatatatatattgattatcatatccgtgctggcggtaaaataacgctcttacagtgaagatgaagtaagtgataaagaaaattattccaattgtaatgatggctggagcccaataaggactatttaaatttttggcccaagtacttttagctgcgagtaagacaatgatcagcatgatactccataaaccagctaataataataaagataagattttttgtttagatgcttttgtagatagtgttttcatttttttagtttcctttctgtaaaagaaatagcatgtttttttaacactacaagtaaatcttgatatcttcttcttgaaatagcaatatctttattttcgtagtttttcataattacattttcactgtttaaagtaattaatctaaagatattgataattgctgaacgtgagattttaaaaaaggtttttggaagcattttttgtagatattcaaagttttgaataaaaatgcgatatgttttgtctaatgtgtttagatatgtcatgcgatttaaatattcaaaataaacaatatcatttgtttgggtattgacgatgccctgatcacttttaaatagtagtaattttcgtttatcaagataatcgatgatatcttgaattgctggaacaaatttcgctttaatatcttgatagcgcagatagctggaaatattaatacctactgcatcgaaaatagttgaaccgtcttttgagataattagtacaagcatatcattattattttcaattaatgttttagcataattgattccttgattatcaaaagaatcttcaataatacagaaatccatttttttttgtaaataacatttccttatcatgaatctcaatgatacgatattcactgtcaatatttttaatgattagttcctttaattgtttgatcacactattatcaacaaccattaatccaatttttttcatttagaaatctcctttattacttgcagttatcttttacacctttattataggggcttacttttagtatattttaattattgtatgaatggtataaaaaatatcttttggacaataaaattagtgatttctcattacttttcgcttgtaaagtagtaaaattaaagtatagataatgactaagattaggaggaggtgcagatcatgcgcaagaacattattacaattagccgtgaatttggtagtggcggtagaacaattggtaaagaggtagcaaaacgattaaacatacctttttatgataaggaattaattgaaaaagtagctcgagagagtggattaaatgtgaattatattgaagaacatggtgaatatgcaccatctagtaatccttttgcttatgcttttttaggtcattatattgatgggatgtcaatgaatgattatatttggatgatgcaaagaaagattattttagaattagtgcaagaaggaccatgtgtaatcgttgggagatgtgcagattatattttaagagatcgagatgattgttttaatgtctttatttgtagtgatcttgataaaaaagtggaacggatcgtcagattatatggggaaacagatgagaagcctgagaaacgtttagctgataaagacaaaaaaagacgagcaaattataaatattatactgatcaagtttgggggttagcgcaaaattatcatttatgtttaaatagtggtgaaattggaatcgataaatgtactgagttgattgttgatttagtcaaatagtagttaagagaaagtaactattactttctctttttatgaattgaaggattacatatgctatactgtattggaaaacattataataaaaagacgattattttattatgttaagaactaaaagataaaataatatgaggataagtagatgataaaagcaattttttgatattgatggaacactattggatcatgatacatacttaatgccatctagtacttttgaagcattaaaaaaattacggaagaatggaattagattattcgttgctactgggcggccacctaataatcttaaagtgattcaagattgtttcgagtttgatggttttctcacaagtaatggatagtattgttttaatcatgaagtggttattcatgaaaaatatattgaaagagaagatattagaaatttattaccatatattaacaaaaatcagattcccgtattatttgtagaaataaatggtaattatagtaatatccaaaattatcgtcttgatgaagctgctagatcactgaataaagagggctatcccattaaagctgttaatgaaataattgaaagtaagataattcaattaatggcatatatagacgagactaaagatagtgaactattatcatatatgcctaattgtaaatcagcacgctggacatcgctctttgcggatatcatccctattgatggcggaaaaaataagggaattgatcaaatgataaagcactatcaaattaatttaggtgaagtaatggcatttggcgatgggaataatgatattgatatgttaaaacatgttggagttggtgttgctatggggaatgctaatgattttgttactgacacgattaatgatgatggcatttttaaagcattaaaaaatttgaattaatttgaaagggtgaaaatgatggagcaagaattaacaaaattcttaactttttgggatcatttaaatgaaaacgaaaaagagttattaaaacaaaatgccactcttcaaacttatgctaaaggcataacaatgcatcgtggtagtgatgattgtttaggtgtggttttagtgagaaagggtcaattgcggacatatatgttatcaccagatggacgtgatattacactatatcgtttatttgcaggtgatgtatgtattctttcggcatcatgtgttttagaaacgattacatttgatgtttttattgatattgaagaaaatagtgaaatcattacaatcacggcaactttatttcaacaattggcgaagcaaaatatttatgttgaaacatttgggtataaaatggcaaccaatcgtttttctgatgttatgtgggcgatgcagcaaattttatttatgtctgttgataaacgcttagctatttttcttaaggaagaagctgaaaagaataattctttagagttaaaaattactcatgaacaaatcgctaaatatatggcgacggctcgtgaagttgtaactaggatgttaaaatattttagtcaagagggtattgtaaaaatatcacgaggaaaaataacaatagttgataaacataaattagataaactaactattgattaattatggaataatcattatgattattcttttttattcaagttaattaattttttttcaagtgattatgagttgaaattcaagctgacattaaagataataaatctatatcagtaatagtaatttgttatataaaaaatagctatactgctagaaatagaatgggaggaagaagtaatgttacgaaaagattttttatggggtggggcagttacagctcatcaaagtgaaggtggatatacactggatggtaaagtaccagcggtttgtgatttaacagttaccggtgaatattctgattttaaagacggaatcgatagttaccatcgttatgaagaggattttgatttatttcaggaaatgggatttaatgcttatcgtttttcacttgattggtcacgtttaatgagcgatgaaggagtatataatgaaaaaggatttgtgttttatgaacattttattgatgcactgcttaaaagaggaattcaaccaattccaactttatatcattttgaaatgccagcatttttatatgagaagtataatggattttatagtcgcaaagtagtcgatatatttgtagaactgtgcaaaaagattgttgatcgttatcatgataaagttgaaaattggattatttttaatgaacaaaatggaattttacagaaagggccaaaaatgttttttggggcagtttgtccggatggagttgatactcaaacgtttgataatcaaattatgcataatactttgattgctcatagtcttattaatgaatatattcatcaaaaaggtggtaaggttatgggaatggcgacagtggttcaaagttatccagaaacttgtcatcctcttgatacacttgaaagtatgaaggctcaaagtgaagcttatgtttttttagatgtttttgcaagaggacattataattcatattattttgcaaatatgaaaaatgaaggaacaatgcctgaaatcttagatggtgatttagaaatattaaagaaagggattacggattcactatctattagttattatatgtcgacaatttcacattatggtgaggagagtctaacaaatattaatgatgttgtaattaaaaagaatccttatttggaaatgtcagaatttggctggacgattgatccaactggtcttagaattactttaagacaattgtatgatcgttatgaaatgccaatatatatagtggaaaatggttttggttataatgatcaaataaatgcagatggccaaattatcgatgattatcgtattgattatatgaggaaacatcttgaggaaatgaaattagcgattcaagaaggcgttgattgccgtggttacttgtcatggggaccggttgacattttaagcagccgggcacaaatgaagaaaagatatggttttatttacgtcaatcgtgaaaatgatgatttaaaagatatgcgtagaattagaaaaaaatcatttgcctggtatcaacaagtaattgcatcaaatggagaagtactataatcgaggagcatgtgctatactatttaatgaggtgaaacaaagatgaaagtgacgatgaaagatattgctaataaattaggaatttcaattaatgccgtttcaattgcactaaatgataaacctggtgtcagcgatgaaatgcgtttagaaattttaaaaatggctgataaaatgggttacattaatcaaaaaagacaatatctatcagtttattctaaatcaaatatttgtattttaatgcaaagttattatgcagatacaggacacttttattcgattgttttacggtcaatcgttgaacaagcaaaagtatttggttatttttcaattttaaattattttgaagacgggcacttcgtagtacctgaatgtattgaagaaaggaaagtggctggaatattagttgtaggcaaaatatctgatagtaacctgctgctgcttaaaaatatcggtgtacccgttgttctagtagattttacatcattatgtacaccgtgtgattgtgttttgacgcataataaacaaggtagttatatgatgactacgcatgttattaataaagggtatcaacggattggtttttttggagatcttgattattcctttagttttgaggatcgttttattggatttaaacagtcactgttaaagaataatattgttagttattcaaaggttgatgaatatattcaaaaatattcttttctacaaggaattgaagaatatgttttaactaatcaaattgataaaataattgaaattttgaatactaaaaaattaccagaggtcttagtatgtgcaaatgattctaatgcatttgctgtgattactgcgttaaaagatatgggcttaaaagtccccaaggatattagtgtcgttggatttgacgatacaccgttgtgtgttaaatcagtaccgcagatcacaacagttcaagttcaaaaggaactgatgggcgaggtggcggtatctaatctaattgatcggattcatcgtaaagataatattccgatgacacaattattaagtgtgaaaatagttgaacgaacgtctttaaaaatttaaagacgttttcatcatttataattcaaccatattctactgattataaaggtttataaaaaaactttttcaagtgatttttcgttgaaattcaagtgataataactaaaaataatagatgtagtaagcgttttcaatattatttaaaaggaggatattatatgattaaaaaggcattgagaataatcctgtcattagttatgtcttttgggcttgttttaagttccatgaatgtaacttatgcaagtgagagtgattttgcaacaatcaaaacgcgtttaaaagattactttttaactttagacacgattgatgatgggtcaaaagtagaaacatgctatgtttcaaaagcaaaagattatcttgatttgattcaagaagatggcgcttttggggatgttgactacaaagcgacatcaagtgctgctaatggaacagcatggtcaccttatttagctcttgatcgtctacaagcaattacagttgcttatcataaagagggaaacgctctttatcatgacgaagaagtaattaataagctaaataaagcaattgtttattggggaaaaatgaatccatcttcttctaactggtgggagaatcaaattggagttcaattaagattttctagaattgctttatttatggaaagcattgtaagtaaagatgcaatggatattatgcttaataaattattggaaaaaacaccagttaaatatggtacaggtcaaaataatttatggtttgatcaaaattatgtttattacgcaattattacagaaaatgggactaaacataccaattctacaggatttaagaaattagatttaaaagaacttgtagatgattatttaagttattgcttagttgttcaaactgatgataatactgctgaagcagttcaggttgataacagtttctatatgcatggtaggcagttctattctaatggatatggaatgtcaatgtttagagatatgagtttttggatttatatgctaagagaaactagttatgcatttgaacaagatgtcattgatttaatggctgattatatgattgatgggacaagctggacaatcagaggagatattatggagctttaccttggatatcggccatatgattatgatgttggctatgataactatgcagcagagtatatcgatccacttaagagaatgattgaatcagatcctgatcgaactgatgaatatcaagcaatccttgataacatccaaggaaaaaatacagctaatggaaaaaatggtaattattatatgtggcgttctggttatgcttctcacatgcgagatgggtacggagttaatattaaaatggactctaaccaaatcatcggtggtgaatggcgtggcagctggtcaggttatgataaagacggaggacaattaatttattggacatcatcagcagcttcaacaatcacagttgacggagatgaatatactaacgtttatccaacatatgattgggctcattgtccaggaacaacaacagcagcacgaatcgttcaagattatgctaatgcaggtcgttttacaaatggaactgaacatacaattggggtatccaatggtaaatatggaaatactgcttatgatatgaataaaaaggggactcaagtaaagaaaggatatttcttctttgatgatgaatttgttgctctaggttcggggatcaattctactgagggagtcaatatccatacaacattaaatcaatgcgaagctgaagatgtaaatgttggtggtcaaagtgttgctgagggaacgaaagaacaaatttataacactaattggctatataatggaaaagttggatatgttttcttagaaaatacggatgtagttgtaagtaatagtgttcaaactaataatccgtcattatgggatgaagcaaaaaagaatgaaactccggctacttttacagcctatttagatcatggattaaagccaagcaatgatagctatgcctatattgtcgtaccaaataccacagcaggtgcagttagtcaatatgccggtaatacaccagttactgtaattgctaataacgaaaaagttcaagcggtaagacatgacggtttaaaacaaactcaaattaatttctatcaagctggttcattggaatataaagatggctatataattactgttgatcaaccttgcagtattattattgatgaatcagaggatacaagaaaaatctctgtagcagtcaatgatacagcagccaatcaaactgtaaatgtaaatttaaattatgataatcaagaaacacaaacaacatttgtttcaggagcattaccatatgctggacaaacaatgacgttatcagaaggctcagataatcgttatcatactaattcttcaatgattggacacgaagtcgaaaaagcttttgatggtgatgaaaatacatattggcaaagtgaagaaacgcaaaatgaatggatcagtatgtttactggcaacaataaacatttagcatctatgaatattctttggggtgataattatgctagtgcttatgatgttatggtttctcaagatggtaaaaattatgaattattgaaatctgtaagtaatggtgatggtaagacagacacgattgaattaaaaggagtctacccatatattaagattatcatgaaagatggaaatggaaattgttttgaaattaaggaaattacatttaaagcaagtgattcaatagcgcttaataaatctgttgaagcaagcagtacgtcaacaaatgaccctggaaatactaaagaattagttgtagatggtaatacaagtacaagatggagttcattacgaaatgaagatgagaactggatcatggttgatttgggacaatattcagaaattaatgctatgagcattcaatgggaatccgcttgttctgatgattatgatattcaggtctctagtgacaaaaataactggataacggttaaagatagtatggcaactggaagtagcttattggatgaatacaattttgatgaacctgtatatgggcgttatgttagagtttcgtcacataaatcaagaactttaaaatatggtattagtatttatgaaatttctgtgtatggttcttataaagatgaggatattgcagctaataaaaatgcattttcaagtacaataaaggatttgaacttaccgactcatgcaattgataataaagccaatacgtcttggatttcgagtgcagccggtgatcaatggatctatgtagaattaaaaggaatttataaaatttcaagtatgcaggttgattggggaaataattatgcacctaattatgaaattcagatttctgatgatgcacaaatgtggcaaacagtaaaaactataattgatggacaaggtggtaatgagaacatttcagatttaggtaatcaagaagcacgatatgttagattaaaattaaatggttctagtggctcatcataccaaatcatccagtggtcagtttatggcgaacttgttgaagcagaaaatttagagaatattgctttaaataaaacagcaacagcttcttcagtttataacaatgtttatactgcaaatagagctattgatggaagttttgaaaataatggtggaaatgatcaatcaagatgggtttcaaatagaaattcgaatgatgaatatattcaaatagatttagaagcgaattatgatttaacgggtgtaaaactttattgggaaggaaatggtgctaaaaaatatcaaattcttgtctctgaagatggaaaaacatggcaaaaggtttatctagaagagaatggacaacctggaattgcaaatatcccatttaatgaaactgttactgctcggtatgttaaaatgctaggtatagaatgtgcttctaaatacggatattcattatgggaatttgaagtgtatggaaaattacaccaagaaccagtggtgcctgaagtaaatattgcattgaataaaacctctaaggcaagtagcgagtttactgaccctaatgatggtaataaaacatatcaatctttattagcgtttgatggcaaaggtacaaatgaaacagttgatggaaagcaatcacgctgggtatctttaagaacaaaagatgatccaacagcaacatcacaatggatctatgttgacttagaagctgattacgatatttctaaagttgttcttaactgggaaggaaatggtgctaaagaatataaagtgcaaatttctaatgatggtcagaattggacagacatatcacatattacagatggtaaaggtggtattgatgaactgacatataaaaatacaacaggcagatacgtaagaatgttaggaatcgagcctggaggaatttatggatattcattatgggaatttgaagtttacggggaagctgtattagaacctgaaaatccaaatgtaaatttagctttgaataaatcttcgaatgcgagctcagaatatgttgattcgaaagatggaaataaaacatatgaatcttcgctagcgtttgatggtaaaggtacaaatgaaatagttgatggaaagcaatcacgctgggtatctaatcggaaatctaatgatgagtggatatatgtagacttacaagatatttataatatttctaaagttattttgaattgggaaggaagcggtgcaaagaaatacaaagtgcaagtttctaatgatggtcaagtttggacagatatatcagatattaatgatggcgatggaggtcttgatgaattatcatataaagatgtaacaggacgatatgtaaggatgttagggattgaagttggaagtgattatgggtattcactatgggaatttgaagtttatggaacaactttaaaatctaagttacaggaaatttataagaaatataaagatttagatatttcatcatacacccctaatagtattgcgcgatatcaagaagcattaaataatgctgttaaagtttataacgatgatgatgttacatctgaagatatcttaaaagcaattgatcagttggaagatagtgttaaaggacttactaagattgttgataaaatggagttggaagaaacaatcaattcagcaagtaaacaattagatacagctaaatatacccctcaatcaattgaattacttacagtcactttacaaaaagctaaagaagttttcaatgatgataatgctacgaaacatgaagttgatgaagcaattaataaattaaatgaagtagtcgcagcattagttgaaaaagctgataaaaataatttaatatcaatttttaatactgcattgaaacttgataaagaaaaatatacttctgaaagtcttactaaagttgaagccttgttagagaaggtagaatcaattattgatgatgaaaatgctgcacaggcagaagtcgatgagatgtatgaccaattgtatcaagcgttagatcaattagtgataaaagaagatgtaaatacaaacgataaagttgaaggtgatgtaacagttattcctacgccagaaaaagagataccaaaagatgatagtacttcagcagctaaaactggtgattcagtatctattcaaatattggcgggaacattattgatcagcatcttaggaattggaattttaagaaaaaagaaacaatcataaaaaggagacttggaattaattccaagctccttttattatataaatagtgacatatcagattcttcaccgttagctaacatagtagcaactcccgataatgtaacaccatcaatcaattcttcttgtttaatgcccattacatccatactcatcgaacaggcaattagttcaacaccattatcttgagctagtttgattaaatcttctaaactgtcaatatttttatctttcataatagtacggatcattttagctcccataccacccatattcatttttgaaagcgatagtttttttgaaccacgaggcatcatcattgcaaacatttttgaaataaaattttttttgattttaaccttttctggtcgtcgaatgatatttagtccccagaaggtaaagaacattgtgacttttcgtcccatagccgctgcgccattagcaataataaatgatgcaattgctttatctaaatctccagagaaaacaatcatatttttattatttttatttccgtttgagatactgttctgtcctttctttattttagcactgctaattcctttattacagctaagctctattagttcattaccagtacgacgacaatagccatctagatctgtagcaaaagccgggtccgtagtttgaatttcaataatatcgccatctttagcagtttctagtgatgctgataattttacaatcggacctggacactgaagaccgcaggcattaattttaattgtttctggattttctatgggacaagcaggatgcattgtcttgattttgggttcatcatgttcttgattaaaaattgtattatataagcgatatcctccattgagattataagtatcaaaaccattttgacttaaaatccgtgatgctatatagcctctaagtccaatctggcaggttacataaataggtttatttaaattaagctcatgaagacgagttcgcaaggaatccaatggaatattaatgtaaccatcgatgtgaccatttgcatattctaattcagtacgagtatctaatagaatcacactgccatcacggggcagtgatgcaacatcatcccaattatattgtttgatcttgtcagtaagaatattttcaattacaaaaccagccatgttaacaggatcctttgctgatccatatggtggagcatagcaaagttctaattcagttaaatcaaaacccgtcattttggcacgaatagcagctgctaaaacatccatgcgcttgtcaaccccatcataaccaactatctgagcccctaaaatggttcccgttgatttatcaaaaaggacttttattgacatattgaccgcacctggataatagccggcatgattagctgaatatgtgtagactttatcgtaattgagatttaattccctagcagttttttcattgattccgctacttgcaacagttaagtcaaagacttttaaaattgatgaaccttgtgttccttgataatggcgatcaaaaccgcaaatattatcagctgcaattcgtccttgtttattagctgggcctgctaggggtacataacttgctttattagtaacaaaatttttgatttcaatagcatcgcctacagcatatatatctttgattgatgtttccatcttatcgttgacgatgattgctccgcgagaattagttgcaatttctgtattttttacaatcttagtttcaggtaccacaccaattgccataattaccatatctgtatctacagtttgattatttagagtaactgtcagcttgttaccggcttcattaatagcttgaagttctgtttctaaaactaagttaattcctttgcttataagatgttgatgaacttcacaagccatctcatagtcaatcggagaaatgacttgattagccatttctacaatcgttacatttattccagttgaatgtaaattttctgccatttcaataccaataaatcccccacctacaacaattgcatgttttggtttatgggtatcaacgtattcttttattgcataagtatcagggatatttctaagtgtaaaaactttatttgaattgattccaggaatatttggcttgattggttttgctcccattgaaagaagtaatttatcataactttcctgatattctttttgtaattgatgattatatacagtaacggttttagtttcaggagtaatagcagtaacttcgttaaagttgcgaacatcgacattaaagcgtgctttaaaactgtcaggagtttgtaaggttaaagcctcttgatcagtgatttcaccaccaatataatagggtaaaccacagttagcaaatgatatatattcatctttttcaaacataataatgttggcagattcatctaaacgtcttagacgagcagcagctgaagcgccaccagcgactccgcctacgataagaattttttgattagtattcatttttttcctccataattattaatctatgattcattttcaagattattataattttaatttaaaattagttctgtaactaggtcacacaattataagaatagtggtttagtaaggaaaattatttaataatgagatattcatgtattttgaattatgtatacatttattatcttcaatattcaatgaagtcaagtattgatttatattagaagtaagattgttatctttcaataatgttaggaaagctatactaaaactaaatattttgataattatcaaagaagtgataaatatttgtaataaaaaatacaattatttttatctattcagaataattaattagagtttaggatatgaatatcagcgttattaataaagtaatttagaatctagacaattatctatattaaattgattgactaatttgttgatgtaatgtaaaaaatggattgttgatattaaattagacaagaccaaaaccattcatattagacacttcttaatgtcatataggcagttttttttgattttgttaaaatgttcattggaaataaagataatctttagttaggcattttagaactagctgaataaataagaaatcaaaggtcattattagatttagtaaccgggttttgtcttaatatacgaaatatccaataattcctgtgataatcattagggcaatcggattaggtttctttttttgtaaccataataaagaaattacaaaaataattattgctaaaaagttgatagagttattttcaacaaaagttagaattaaaattgttgcaccggcagacatgatcaaaccaactgatgtagcttttaaagtatttagaatatttgtaattatttctagtttttgatatttagtaaaaagaagataaaggataattgaaattattgctccagcaaaaatacaaccaattgtagcaacgatagcaccactaattccagctagttgaatacccacaaaagtagaggtattaactgctaaagggccaggtgtcatttgcgaaattgtgataatgtcagtaaatgtattggcactgatccaatgatagttattgacgacctgttcttgaatcaaaggaatgattgcatagccgccaccaatactgaataatccaattttaaagaaaattataaataaatttaacattggcagtacctccggcgatagtatagttgagcagtggctacgataattgtaattaagattattacaacgatattaactttaaagatatagctggcaatgaaagtaataggaatcatcgcggttaataattttgaatgttgttcattaatagctcttgtcattcctattaggatatccacgataatagcagcaattccggcttgcattccttttaagatagccataatgatgtgatttgtactaaaaacttgataccataatgaaacaactgccaaaatagtaattggcggaataatcgctccaatgcaactaacgatagttccaatggtaccggcaactttataaccagctaatgccgcaagattgattgcgattgctccaggtgttgtttggctaattgccgacatggtgattaagtcactttcattgaaaatttttcttttttcaacaaaatacttacgaaccattgatacaaccacataaccacctccaaatgtaaagctgctaataaaaatattgataaagaacaaccatgtaaggtcttttagtttatttgctttcattaatattctcctttatatatcaagattatataagttgtatatacattagtaaaatgatataatttaatgaaatacattacttttattcatgatagaagaaagctatgaaccttagacatttattaatatttaaaacagtagttgatacagggagttttactaaagcagcaaaacaattatttattacgcaatctggagtatcgcatgcgattagggaattagaacaacaaacaaatgctgtcctattcgatcgtttatcaaaggcaattatattgactcctgcagggaaattattattggaaaaagttattccaattttatcactatatcatgacttagaaaaacaaatagatgttttggaaatgagtgcgcctctaaaagttgtttcaagtattactattgcaaccttttggttaccaaagattctaaaacaatttgcaagcagctatcctaatattaaggttgaggtgcaagtggtcagtgcaaaagaagcattggcagttttggaatgtggagaagccgatcttgctttggtagagggagtagttccaccaggaccctttattgtaatagatttttcttcttatcaattaaacgttttatgtgcaccagattattttgcggataatgaaattacattaaaagaactttgtactcatgatcttttgcttcgtgaaaaagggagtgcaactagagatattattgatagttgtttatatttgcgaggattggcagcatatcctaaatggacaagtgtaaattcaaaggtcctgattgaagcatgtaaggctggatttggttttgcggttttacctactcttttagttactgaggagttaaagcatggtactttaaaaacggtggaaacagatgaattgctttataataaaacaaagcttttatatcatcaagaaaaatatataagtgaaccattggctaaattaattgatattattggagaggctgaataaaagaggctataaggaataaagttttttaaacttttaggtgttatagcctcttttaatgtatttagagtagaagtagtagtctttttatggttgatgattttatcgatatttttataataagttagaaatattaataaaaaacagtaaaatatttattttttactttaaatcactaatatttatcattataataaaaaagtattttgaaaggataaagggtaggatgtttaaagattatgtattaagtttgaaaaaagaatttgcaggttataatggtcaaaagctagtaatggatattttggcaggattaaccgtagctgcggttgcgttgccgttagctttggcttttggggtgagtagtggtgctgatgctggggctggtttgattacagcgattatagcaggattattgatcggtggcttatctggggcatcgtatcaaatttctggaccaactggagcaatgtcagcaattttaattggattgtcaactacatatggtttacaaggggtgtttgttgctagttttatttctggggtaatgttattaattgcttcattatttaagtttggtaagatagtatcatttataccagctagtgtaattactggatttacgagtggaatcgcaataattattgcaactggacaaattgataatttttttggagttacttcgaaaggaagcaatccgattgaaaaaatcttatcttatcgtatgttaggctttaatgtaaatttagaggcactgttttttgggatactagtaatagcaattattattttatggcctaaaaaatggggaaatatatttccggcttcattagctggaattattattgctttgattattaatttagtatttaaatttaatgtagcagaggtcgggagtattccatctacattattgcctaaagctcgtttgtcattgaatagtttaaatttaacagcaataacaaatctaattattcctgcatttagtattgctatgttaggaatgattgaatcacttttatgcggtgctagtgctggaaaaatgaaaaatgaaaagttaaatgcagatcaagaactttttgcacaagggattggtaatatggttattcctttttttggaggtgttcctgctacagctgctattgctagaacgagtgttgcgattaaagctggcggtcaaacgcgtttagttagtatttttcatgcagcggctttactaatttcaatgtttgttttaggtccatttatgtcaagaattcctttatcagctttagccggtgtgttaattatgaccgcctggaaaatgaatgaatggcatgaaattaaacaatttttttcgaaacgaataaaaacaagtatgacacaattcttagtaacaatgttagcgaccgttgtatttgacttgacagttgcaattgtaattggagtgtttatatctatgattttatttgtaatcaataattctgatttagatattgaaacaagtgatattgaaccacaacgacttgataaggagttaaattatgatcatcaaaggactaaagtaatttatatggctggtccattgttttttggaaatcaagaacaaataattacaaaagttaatgagattttaaatgaatgtaataatattattttttcaatgcgtggtgtaccttcaatcgatgattcagggatccgggagtttattgatgtagtagaattatgtcgccaaaataatattaatgttttatttgctggagtccaaaaaaatgtaatgaaacaattcaagcgacatcatttcgtagaattagcacaaccaaataatttttgttgggatgttattaaagcattagataaaattgaacaaaaaggataaaaaaacttggatttaaccaagttttttttcatctttaataatttcattgattgtatattgagcattttccgcacgttctgcttcatcgctattatatgtgatcagggccttccataaagcccagccacaagcacgatcaatcatcccttgatctagttttcttaagaatcgctgtcggctttcttcttcaaaaaaagtccaagccattgcataatcacaagaaggatctccaacacctaaaacaccaaaatcaattactgctgctaatttaccatttttaacaagtaaattgccaggggctatatcgccatgaacccaaacatttaaatcagatactgatgcattaagggcacgttgccagattttcagtagcagctcagttggtaaaacggttttaagattttctaaagcttcgattgtttcattgtgatatactgctagatcaccaccacgataatagttgtgaagtcctgcttgaggaccattggttgtatcaattttctgaaattcttttaagaatttagctaggtcatcagcaaattcatttaaattattaatgttttgctttgttaaagtatcaccttctatatatttgttgattgaccaagaaaatggatatccacagcttggataacctttagctattggcgaagaaattgtcatggttaaatttttttggagataaggtagccatgtaagttctttttcaacttgggctgcatagcctttaccactaggcaaacggacagtcatctttgatcctaaatgaaatgttcgattatcatgtccgcttttagcgactggttcaattactaaatctttccattgaggaaattgttcgttaattaagttttgtactagttttttattaatttcaatcatatcattattcctttataaatttatgttcattaatcataatttgtaattcattaataaaatgagaaacatggtaagcaccacataattgatgatgtactctaattgatagtgatagaagagttttatcattttgtttgtagtatttaccaattgcgaaaattggtaataagtaatgtggcttatcattaattgttaaaaaaactcattgaatgttaactagggtggacaggaaaagttaaatgaattaacagattcttgtttaggaaatattttttaatttcaccgtaagttttaagattatttaagtaatttggatagaaatatttaaatttataattatattcactccataggatagaaaaagtttcatcgtcgaaatgaaaaatagtataacttggattcattgttttatatgttcctaaaattccttgatttatatatagttagtttttctattttaagaaggctgatcttcgtgttctaatcatatttacttacctcgcttttcttatattctatcagatagtaacctagagtaaaagttttttcactttagtgtgagtttagcagggggctttaggctattaaataaatacaaaaaagtttgtagataacaatcgacaaactttaaattaattatggtacaggaaatgggacttgaacccacacgagaaaatctcactagaacctgaaactagcgcgtctgccattccgccactcctgcattattaataagtacaataattgttgagaagatcttgagataatttgattgcatggaggatagttaatattgagaaaaaagagtaagcaaaaacatatgttttaaaaacaaaaaccattactaaaccaatgaatccttctacaagaaatataattaaataaatgtaagagaggcaggttattaaaaatggtttgctaatagcaatgttttttaacaaactgaatttttttagtattagcaagacaatatataatccatagctagatattgaccataaaactgttctaaagatcaaatcaaaaagaattgtttctattttgaaaaaaggatagcaccaaatataacctagacacattataatcaaataaatactgcttagtattaatgcctgtcttttcattggctagtcctcctaaaagctatacatgattgtgatatttaatgacaggttaatctaaattaaaataattattaaagtcctttaataatattattatacatcatttaatttgatttgttaattagttaaacattttgttataataaaaatagtgaaaatggaggttaggtataatggctgttttagacacagagattttagttaattattattttgaggaaatttgtaaaattccccatggctcttataatgaagaaaagattgctgactttgttgaagcattcgcgaaagaaaaagattttagatatcatcgggatcacttaaataatattgttatttacaaagaagctagtcaaggatatgaaaatcatgaaacactgatgttggaagcacatatggatatggtcaatgaaaagaataaagatagtaatcatgattttgaacatgatccattagatttgtatcttgaagatggctatgttagtgctaatgggacgacattaggagcagatgatggctatggagttgcttatatgttggcaatcttaagtgatcctaatgttaaaaatccacctttagagtgtgtttttacagttgccgaagaagttggtcttgatggagcgttaggttttgatgcaagtttattaaaggcgacaagaatgattgggctagatagtgaaaatgaaggagaaatttgcacaacttcatcaggaggctgtgatgtaatgattactaaggaattatattttactagtaatgaaaatccaacttatacattattaataaaaggattgtcaggaggacattctggaggtgagattcatcgcggtaaaggaaatgccaataaattggctgctcgagttatgtatggtatgatcaaggcaaatttagatatccagctagtggatctaaatggtggattaaaaaataatgcgattccccgtgaatgtgcaattgtttttgctagtacaagtgattttaagttacttcaggaagtggcagatgagtatcaagattattttagtgaagaatttgaaattagtgatcctggtgttaaagttgagttatcattaaataatgatattgcacagcaaacgttgagtataaaagaatcaaaagatattataaaattaatgatggcagctaagagtggttttgtcgaacgttcattagtgattgaagatttgacaacggtttcattaaatatgggtgtagtatcaattaaagataaacaattaaaaatagattatttactacgttcaccaatgaaaagcgctgtgatgaacatggttgatgaattagatattattgcagatgcctttggtggcacaattactccagcaaattattatcctggttggaattacgaccaacattcaaaattacgtgatttatttaaagcattttattttaaacgtactggagcagaagtaaaagaagtagctactcatggtggactagaaacgggaatctttaaagggaagatgccagcgctagatattattacgatgggtcctaatatggcagacatccacactccagatgaacgtatggaagttgcatcatttgtaaattgttacgaaatattaaaagattttattgcgacattataaaccaagtgttaacttggttttttcattctttgaaaagggatattgttgaaaaatggcgataataggaatacaataatatgagttataatagataaaagagggaaaattatgtttaaaatgaaagttgatttaaccaaagatccaattttaaaatcattgttgatctttgcgtttccattatttgtggctaatgtttttcaacaactttacaatactatggatacgatgatcgtaggaaactttttaggggatacatcattggcggcaattggagcatgtggtgctatttatgaattattagttggttttgctttaggggtaggaaatggattaagtattgttacagcacgaagttttggtgctaaagatgagaacttgttaaaaaaatcagttgcgggatcaatcgtaataggaatcttgttaactattattttaatgcttttttcacagttttgtttatatccgctattagaattattaaatacaccagcaaatataattaatgaggcatatgattatatttttatgattactatttttgttggggtaatgtttgcttataatttgtgtgctggattattgcgagcaattggcaatagtgtaatgccgcttgtttttttacttatttcttcagtcttgaatgtaggattagatttattatttattactcaatttaatatgggaattcaaggtgctgctattgcaactgttattgctcaaggagtttcggcaattctttgtttttattatatttataaaaaatgtcctattttgcttcctcacaaagagcattttaaaattagcagggaactatatcaagaattggcagggcaaggtttttcgatgggattaatgatgtcgattgtttctacaggaactgttattttgcaaaccgccatcaacaaatttggttatttaattattgctggacatgttactgctcgtaaattaaatagtttttgtatgatgcctgcagcaacattgggtctagccctatctacttttgtttcacaaaataaaggggcaaatcaaggattgcgaattcgacaaggggtccgttatgctaatttaattgcagtagggtggagtgttattgcaacagttgtattattctttattgccccaactctagttcaattattgtcagggtcaagtagtgcagtagtaattgataatggttcattatatttaatgctaaatgctccattttattgtatgttaggaatcttattgaatcttagaaattctttacagggattggggcgtaagattattcctttagtttcaagcataattgaatttattgggaaaatagtatttgtttggctgtttattccattgttaggatattttggggttattatttgtgaaccggtaatttggtgttgtatgtgtttacagttagcttattctttttatcgggatccatacattaaagaatatagaaatattaagaaagaggctgtaacgggtaaataattatgttgtggttttgtcttgtgcaaaaagcactctatgatgaacgcttttttcagacttttgataaagtgatactccaaaacgagtatcgctttttttatattgactaacttatagaaaaatagcgtttttggattacatacagtgttgttcccctatcttgctattatttttagaatgtgatacgcaaaaatcattagtccttgatgctgattctccttaagacctttttactcttgtatatctcaaattgtgatgttttttgcaattctatggatttaatttgtatttcctatatcctaacttatttgtagcgctgtattctaaaatctttatgttgggacatacatattcatattttttaatgtagctttttttgtgattgatcttttatatggtgcatacatcttttgtttgttttctaatatcgtcttacaaattgtcagtgtgatatattctggatttaaacatatattttttgtcctatctttatattcttcatttagtaacgcatacgttggaaaaacgatacactgttatgcacgttgcctgtgacgcaatagtttaatccaaccaatctgtttttatcacaaaatgtttgatgggaatatactattcatatagatatgccgggaaaccgtaacagctgtttcaaaatagatcctgatgtaacatttatgcatataaaatacgattactataagcatacaaatgtatttaaatctgaatataatatccaatttgggataagtgatggaattataagaattatatatatcagcgtaacggtaatgatttaaaaacatatataccatcgatgaaaaaaatgaagcaatctatggaaagcttcctaaaagaacaccagcaggtgtaaaattagagatataaattttttcaaaaataaggtaattcttttaaaatgcgtcaaaaaacagtaaattaatgaggaaaagacagagtaaaaaggctaaaattttatcatttattttaatttacaaaaaaaagaactgtaatactctaaaatagctaaaaaactacacaatcattacagccgctttttatcatatgtttttttataaaaagtaacaattcaatgcaattaattttagataattcctttgaattaaaatgttgtcatcttaatttgatggtattggtaaaattattttctttatatatatttcttaattctattttgataattttgttttgaatatcaaacaaaatcttattatataaatttacaatttattgaatattagtataattaaagtataaagacattttcgttgcactgctattgcaaggaggtatgatgtttatgaatgataccataaaaacaattaatcacaagatacaagaaatgtcttttgaagatttaagattgatttgcacaaaacatagtattgatatttcagatggaaatctcaatgcaattttgtcactcataaaaaataatccatcaactattatgtttgctgactatcatccaattatctatattcagattttgaataaattagatgataatattttaaatatattcaagcctctaatagagaaggattatttaatgcatgatatcaaaaagttgtgtaaaatcaattaaggatttatcattttgacgaagaatgtctttaggtatgataataaatgatatataatttaatgcatatgacaattttaaaaatgttgcagtttgacattgtttgaaatcatcagattcagactaatttgactatcatcgatatggaatactaagatagaactgaatagtataaaatagtagttatcattccatatattatattaatctagcttacagataaagaaaaaatattatgattgttatatctgctgcaaaagcatctttaaaatttgctaacatttttataatataaaatttctctttagataaacaaaactaaagagattttttgttttaatattctaaaagcagtaaataaatacatattttgatagaatacaattggcggtaatataatgtatgcagctgattatttattaaaaaaggattgtagcaatatgagttttgtaggcatacataatacaaaaaaacaatatagaggattgtataggattaatacttactgcaaatataagctatattgagttcttttctttaatgcataaagctattaaagagaatattactgagtataatgatggaatatataattttattgttgatttaatagatgaaaataatgattattttgtacaaaaagttcaaatagatgctaaggatgatgctccgagattttcaaataaagattagctaatagaaaatgggactaaaattctaaaacagaagatattgaaattagttgggctgtttggacttgatgtaaaatataatctagttgggctctcgataaacactctaaacttctatccaaaaacacaatatatgaataattgctagtataaaagaacatggagcgcagcttcatcaaaactaactacatttaaaatcataagagctcctttttgatatagctgttaaactaaggtattgtcatcctctatactcattgtatccatttgttcttttgtgataccatttctgtttccatattcaatccaatattttgttgatgctttaataaataattttggggtgagcggcattgttatatggagtgttttatagttttttgataggattgaatttgctaatttctttacttttcttgttacaaatattttgaaaggggtttttaggattgcttctccactaccaatttttaaaacagatccaaactcacaatttgttttcttacaaaacagctctatcattttaactgctaaatcattttgtgtatattctaaaaatccacaatttattattactgaaattactggttttttatctggtaagttgttttcaagacttttaagaaaatttaaaagtgtagcaggaatcccgtcagcatataatggaaaaaccagtaacatatcggagaaatcattcattttagaacataatttatcatgattttgctttgttatattgtaatattcaatgtctttattatatttttttgaaaaaatgtctgcataacatttagaatttgatttaggtgctcgcggacttccgtttaatatcactattcgctccattttatcatctccgttttcacagttttttctaggttttgttcatttgtaaataatattttatagtgtttaaaattcatgtttttagcatttctttcaaccagagctttaaatatctctttttcttcagtgcctatttctccataggcaataattgtagcatttttcaattctacacttctttgaacatgatgtgtttctccgtttagtattctaataaatgccttttgaatcggaattgcacgttcaagcattgtcttcataggggtatcataaccaccatataatattttactgatataaattaaattattactcttggcaatgtacggatatacttttgttgcatcgtcacgtataacacatttccccggtgtcttagtccaacagctaaagcatccagtgcagttagctatatttaatgatgatagatctataaattttgtattagaatgatctgatacgtcaagatttagatatttatcacttaatattaatttcatttttacctcctaaaaatactatagcaattgataaaaatatatcccattatattattatgtcccaaatatactgaataattttccaaaattaaaatagtaaacttacattacaatttaaactttttcagtacttattatagcatggtatttatttcttgtcttttttgattatttagaaattatatagtgaaaataatatcaaaaaatcgtaattatagcgatagtggtaacattactctttgagataattatagaaaaaataactatcttactcacaaaagaaaaagatagttattatattaatcccaaaatccaagaaataattgtttatcagctgtatcgctattcatatatactgtaatctatattttaaataagattaaatatcaaaatatatacttaaaaatacattatttttattatcttataaatcttatggcatgtgatttcaaacaagtaatcaattccccattatattcaaagccccatataaaaggtatgtattttctcctttataatttttctaatatattaatgaataatgtttttcttaggtacatacaaatttatctgtttttaattgtaataaattttataattttaaaatacattttaaattaataataaatatgatatggtaaagaagaattaccatcttaaaaatggttttaaatataagttttaggcaatttttcctaacttcttggaaacttttcttactttctttttaaattttttagaggtcattgtcgcatttccggagatagtattcatctccggatttattgtatcgtaattcaacaaatacttgtattatagataccagtatttgcattatttttgttccattgcattttttgcccaactatcatcttttagaatagctctaccaacaccaattaaatctgctttgtttaattgcagtagtttttcagcatccatggcattagttattccacctgtcaaaataactggaatagaaactttttccataatatgctctgtcatatctgaaaaatatcctggctctttattccatggaatcatatagcgatttattccaccagttatatcaaggatatctataccataactttcaagcatttgagaggctttaatggaatcttcaattgttgagccgccagccatataatcacacccacctaagcgtaaagcaattgggaagtcttctccaacttcacttcgaactgcttcaataacttccttatgaattctcaatcgaccttcaagtgttgtacctgtatattcatctgttctatgattggttattggcgaatagaattgatttaaaagatatgcatgtgcagaatgaatttctaccccatcaaaacctgctaactttacgcgtctggctgcatcagcaaatctttttactatatattgaatctgttctttactcaattcttctggtatttcgatattggattctttcattgttattggtattgtattacttgcactaacagtaggtaatcctgttcctcttgccattgaaccggcatgatttatttgagcaaacgccttgcttccattgttatgaattatatttaccaattgctttaatccttttatatcgctatcctttgctactgacatttgtttaggattggccattccttgaatatcaatgtaactgtgttcagtaatgactaatccaatatatccaccttttgttttcttatcataataatcaagaattctttgacttacttcaccatcatcagcacttgatgttgccattgggggcattactaatctgttttttaacgtcaatccgttgattgaaattgatttatctaaatttctcatcatcattactccttttttctttttattaagtgtaatatagcactaccttaacaaaaataacagtatgcacttttaggtaagatactatctaaaaggagagtttaaaatggaagaaaaaataagtatagatgtaaacaaatggagcagttaattcaaaaccatcttgaatatacaatgtcaattataggtggcaaatagaagatgaatattttattttagctttggaaaactgaattaatgcgatatagtgaattaaaacgtccattggggactatatcacacaaaatgttaagtacacaattaaaagaactcgaggctgattatttcattataagaaaagaatatccttaaatttctccaaaagtagaatactatctttcaaagcgggggagtctttaatgcctgttttgcaggaaatatgatattggggtgatatgtatataaatgatttaataaataagtattttaaatagctaaaaactggactctttgttagaatacttttgaggtaaatctatatgatagctagcagttctattaagaaaggaaagtgatatgagctttgtaggcatgaagggctgattgctttttttcatttaactggtacagtttttattctagtatcacatttcttgaaaaccaacatagaaagtatcgaaaagagaaataattatttataatagttaaaaataaagatatttacattacatttatgaatatccaaaaacagttgaaataaaaaagaggtataacccctctagaataaatttattctatttagttacagcctatttttatattattaataatataaaaataagaattaagcagcttaaagtaaaatggatggtattatataagtaaaaggggtgaaaatatggaaataattaagttaacatctaatttaacctattatcgtcagcaggcagctacattattgattgaagcatttccatatgcatataaagattgtgccgagctagaaataacaaaatgtttatcgacaaatagaataatgctgggggcagttgaaaatgatatattgatggggttggttggggctattccccagtatggaatcactgcttgggaattgcatcctttggcggtttctaaaaagtggcaaggtcaaggtattggtacaaagctttgtacagcattagaaaatgagcttaagaattgtggttgctgtaccatttatttaggcagtgatgatgaatttgataaaacaacattggctaatactaatttatttgatgatctatattcaaagataaaaaatattaggaatcttgaacgacatccctatgaattttatcaaaagataggatatcaaatagttggggtgattcctgatgccaatggtttaggaaaaccagatatttggttagctaagagtttagtaagataggatgatgaaaagatcaaaatatttcattttggtctttattttttggactattaagattgcataaagattgatacgaggggttgttgaaacgagtcaatttgctataatttaattaatcaagtcagtcaaaggggtgataaaatgaaccaaaaattctttgaattaaacgaagaaaaaagactggccattattaatgcagggttagaagtatttagtaaaaatgattataaacatgcattaaccgatgatattgcagccaaagcgggaatatcaaagggactattgttttattattttcacaataaactagagttgtatcagtacttagcacaatatagcgctagactagtgatgaagttatttgaaaaaatgaatattatagatggtaaagatttttttgatgcaattaaattagcagtgttaggcaaaatggaaatgatgtctaaatatccatatatttatggcttttcactgcgctattaccaaaatcgtaaggaaatagtaggaaatagttatgaacaattatatgcagaggtaatagcatcatataatttaattaaacgtgctgatattagtaagtttaaagcaggagttgatcctgaagaagtttggaacataatttattggatgtcgcaaggatatatggatagatatcaggatttagaaaatgttaatatgaaagagattcaagatgagtattttagatatttggatattataaaagagaatttctatcgggaggaatttatatgagtgttgttgagattaatggtttaacaaaagattatggtaatgataaaggaatatttgatgtctcttttaaaatcgaaaaaggtgaagtttttggctttttaggacctaatggtgctggaaaaactacaacaattagacatttgttagggtttattattcctaaagaaggaacctgtttaattgaagggatggattgtagtaagaaaattgcagagattcaaaagaagattggttatattccaggagaaattaatttaatggaggaggttactggaattcagtttattaaatttatggctgagtatcggggaatgaaggatttggggcgtgctgaagaaataattgaacgctttgatcttgatcctcatgtaaaaatcaaaaagatgtcaaaagggatgaaacaaaagataggtttggtagtagcttttatgcatgatccagctgtttttattttagatgaaccaactagtggacttgatcctttaatgcaaagtgagtttattaatttaattattgaagaaaagaagcgtggtaagactattttgatgtcctcacatatgtttgaagaagtagagaaaacatgtgatcgggtaggaattattcgtcaaggacgaatggtgagtattgaggatattgacacattaaagaaatcgaaacaaaagatatatataataacatttaaaaatcatcaagatgcttacaaatttcaaaaagaatcttttacaattagaaatgctgatgataatgttgttgaggttgtaataaagcatgaaattaatgaattgatcagttgtttaaataactacgaattaatgaattttgatattgcacaccaaagtttagaagaaatttttatgcaattttatggaggaaatcaacatgttcaataaagcgctatttaaattagaatggaaatctaattataagatactagttattttttgtttgattttgacaatgtatacaacgatcatgttagcaatgtatgatcctaagctaggaacagcgctagaaacatttgctaaaagtatgcctgaaataatggcaatggtaggaatgagtggtaccccgacaacactgattgattttctctctacttatttatatggtttaatcatgattgtttttcctttgatttttggaattttactagcattacgtttagttgttcgaaaagttgataatggtgtgatgagttatttattatgtagtggcgttgaacgtagatctgtgtggtttacacaaatgctggttatcataacaaacttatttgttttaattgctttttgtacaggtttagggcttggatgtagtgctttgatgtttcctggtgatttggatattggagcttatttggttttaaatttaggagttttcattttacagttaacattaacaggaatttgttatatgtgttcttgtatttttaatgagtaccgcttagcatcgctatttggagcgggaatcccgatagtttttattatgattcaaatgctttcgaatatgcaaggaagtatggaaggacttaaatttgcaacattattaactttatttgatcctcaaaaattgattaacggtaataatgaaggttatttaatgttaggaggattacttgtagtaatgattgtttgttatggggtaggtggaataatttttgaccgtaaaagtatgtctttataaaaataaccggtcccggttatttttatgtgtctagacatttaaagagaattccttttaattaagatatttaattgatataatataaaaaatggagggaatttatgaagagacacgagcagttgggatttaatttttttagatattgtaatgaaaatctttctaatactaatgaatacaatattgctagaattatcattgaacatattggtgatattaaaaccgtttcattagagcagattgctcaagaagcaaatatttctattgcttcggttagtcgctttgttcaaaagataggatacagttctttccaggattttaaagatggtttagactattttattcgtaatttaaatatggtaagaacggtatctaatatgcagcagtttatgcgtacatcattggataatttagctgattctttatatgttgaagctatcagcaatcttcgtcagacaaaacttaatttggacatggaaaaacttgttgctataaccaaattattgcttaatagccgtagtgttacatttattggtgatactcatgaaatgattgacttttatactgtgcagttagatttggtggcgaatgaagttcctgcatatttatttgatttacaggaatttcaagatattcatagtgatttttttaaagatggagatactttggttttgttaaatgtgtccaatgatttttatagtgaaattcaaaaacgagtagtagagaaagctagtcagaagaatttaaaacttgttgtttttgctcaagatgatttagctgagcagaaaatatttgattatatttatcaatatggcattcctaaatcaattaatgatggctattattcgttattttatttaagtcaaattatttctgaattaatttataaagtacgagtaataaaaaaatcgtaagtttgatatcttctttgttaagagatatcatgaacttacgatttttattgtatttagtaatgtttttttataactacaccagttgtcactgagatgatgataaataatccagcaacagcaagatttaaatcgtcacctgttttaggtgcagtagtagtatttgttgatgaagcaggtgtttctggtttaataacaggagtttcactaggtgtttctatcttaacatctttagtccacaagtgatcttttacaaagttagtgaacgattcacgccaaacgtaccagtcatgagcaccatttaaaatttctaatttgtaattggttagatttaatgtatttagcttatctacgaatccagttgtagtacgatcgctcgcagtattataactatcattcattaaggccatatcgatgcagccagcagtaatatataagtttggttgatcaagatgtgcaactttacttacatcaactggaacattagctcctgaaaagcagccaaaatatccaaattgatcaggatgggtctggtataaagtcgtagttgtcatagatcccattgataatccacaaaatgcccgatcgtttacttcttttgatacattgtaatgtgtttcgatataaggcaaaatattattaaataggttattaataatacgatcatagtcccaattgaagtatgtattatccattgtaacaacaattgcttctttagttaaactatcagcaattaaattatccatgatatttggaactgcaccaatagtcatccattctacctcgttacccccgccaccgtgagaaacatagattgttttatatgttttattagcatcataaccattcggtagatagattcctaaaggttgagtagttccatcttcagctaaataattgacaaatgagtaagtacctgttttaccatcggtacgagggttgatatattcttgtcctttagtctcaccattacctacataaaataggctccatccagcatctgaaccatcattagcaagtgcgggattagcaggatctttgacattagtttcactactgccatctgaatattcaatattgaaagcataaaagtattcatttgcaggtaaagggatcgttacctcaaagatttcatcttcaatttcagtcattgaataatttgcggcatcaccattaagattgtaccctccagcgaacattccatcttgatattgataagcattataacatgggatattagccccgtcaccagtatttgcaaatgactgtacttcttcgggtttataaaattggaaaccaccgcttacgctaacatttgttgcatcacgcgcatctttatctttgtaaatgaaggttgctgtatagtctgcttcccattctggattagtatttttctctaccgtcacaccgggtgtgtatgtttgttgtgctgataaaggggtggcaactattcctagcatcattgtaagtgctaatgatgatgttgcgattaagtttcttgttttcatgatattctccattcaatcatattttgcaactagttgttttaaacatatatgttaattgtattataaaagtaaaaatttgatatttaaatcttttcttgtgtaaatcacttgataaaaatgtaagcgttttacaaaaaatgtaaaaatgagggcatttgcttgttttatcctaatgattagcatatcattaaggtgatagggtgtgatagagatgagactaaagagattggggttacccgcttttttattttttacctgttcaaattgaaaatttgaacatatagacttaagtcagttgagcatacgaagtatgcgaaataaaaaacataaaacaaaaaaaggtgataatcatctgtagtgattaatcaccccgtggacaaaatttattttgtcccttttttattttttttgcttctaagtaggtttttatgaataattgctttataatataaacataagattttatagagaaagtaatggtgataatatgtatgttgcaacaagtagacaaatgaaggcttacgatcaggctttattaaatgagggatattcaatcgaagaactagtggataaagctagtaatgccattttaccgcattgtttgggttataataatatcgtgattgtttgtggaccgggaaataatggagctgatggtttaagtttagggattaaactacatattcgagcacgaaatgtgaagttatactgttttggaaaccctaataaattttctcaagcaaataatttttatattgagcaagcgcaagagatggaagttccaattacttttatggatgaagaagatatatctttatttataagtgatgcacaaaaagcagatgtggtaattgatgcaatgtttggtttcggattaaatggtgaagttcgtggagtagctaggatattaattgaagaaattaataatttatatgatatagacatcatcgcaattgatattccaactggattaaatcctgatacaggaataccttatggtaatgtgatttgtgctagtaagacaattactttaacagcaatcaaacaggcttttttaaatgaagagtgtcatatgtatacaggagagattgcagttgaaatattggatgctaaagatttacgtcaggagcaggggcttgctaaattggttagtccatcatggatcaaatatcatttaaaaccgcgtgcttattatggacataaaggaatctatggcaagattttacatttaactggatgtgattactatcgaggagctgctttattagcgtcaaaagcctcggtttatagtggaagtggtgttgtatgtgtttgttcaagtgaaaaagtaattgatgcgctagcaatagttactcctgaatgtacttctaaacttcgtaatagtaaactggaacaagaacttttttatgaccgtgatgcaattttgattggttcaggtttagggttaaatgaacaaagcgagcagtatgtaattgatactttacaatatgccaattgtccaatcgtaattgatgctgatggtttgacgattgcagctaaacatttagatttattaaaagagtgccccgttcctattatcttaacacctcattttggtgaatttaagcgtttgtgtgcttatgatgatgaattagatatgattgataaagttggtggttttgctcgaaaatatggtgttactgttgttttaaagggtcctaacacattaattacagatggtcgagagacatatcgtaatattacagctaataaggcgatggctacggctggaatgggagatgttttagctgggatgatcgttagttttgttggacaaggctatacacctaaaaatgcagctattttaggaacttatctacatggcagctgtggggatgtaataggggataattcttatacagtattacctagtaaattaattgatttgattccacaagtaatgcatgaaattatcaatgaataattagaacttgaaatctaaatttaattttaatagatttaaaaatatatgtgaaaaagtcatcaatagtgatgacttttataattagtatttaagcaagataaaagaatgtattaaaatcaataaaatagaaattttttgatatagggtatttaactatgatgcatttataaaaaaagataatcacgtaaattagttttatgctcatctgctttagaactaaaaaactatcttaggattatctttgttttagtgtcaatgggggttagtgatgccagaaatctttttgaaatcatcttcagataaaggcttattaagataatagccttgaataacatcacaagataaatcttttaacacttttagctgttctttagtttctactccttcagcgacacaagttatatctaattgttgacacgtattaatgatatttttgattactaatttagcacggtgatcatgataaatatcgcttacgatctttcgatcaagtttaagtgagcttaagtgcagcgagtatagtatataaatattgctatattcagcaccgaagtcatctaaagcaattttatatccttcagctaaaaattgattaacaatattttttaaactagcagaatcaattgatccaatggattcagtaacttctatttcaattaattctttaggaatattatagctttcaacgattttattagtttcttctaaaataccaggttctaaaatagttgctcgagaataatttattgaaattgggaaaggcttccaagtagtttttaaccagttactgagaattcggcagacatcttttagaataaataaatctatatgtctaattaatcctgctctttctatttctggaagaaaacgccctggtggaataattcctttttgaggatcgttgtatctgatcaatgcttcagcaccacaaatttgattagttttagtatgagccttaggttgtaaaaaggttaaaaattttccatttacaaaagcagtatttaaacgctctaatatttttgctatcgactgatcagatttagctaatttagagtgtatttttttatttacagcatgtcttgttttttcctctaattgctcttgcattgtttctaacacaagtgaattcttttcccaaactttttcacaaatgatccattgatcataaaattcaattagctcttggtaaaaagtatcatatatatgaatgaagttttcatacgtaatatctggacaaagcactataaaatgggcattactgatccgataacatgattttttatcaaaaaatttagtaattgtttgtgcgatgaactgtaagatttcatcaccttggacgatgccataccgctgattatatttttttagattaatgatagttatttcaatcattccaaaagtagaataaatatcagtatttatatttcttatagtcttaatataagaatcgtagttagataaaccggttttttgatcatgagtaagggcataagtatatttagtctgcaaattataaatagtggtaattttacaaataacatcagcaatcacctcaatagattttgaagcgttaatatgttgtttaacagtttccacgagcaagcatgatacaagcttgtttttgttataaatgccgataaataataatggtagtggtacatccttttcaaaatatagttctgtaatatttttataacaaaaatggtttttatctaatattacaaagtatttttgtggtgcgacagcactaacaatattttcaaagtgttccttactgaaatgagtatttttaatattagagatttgattattataattccactttgaagtcagagaaaatttttgttgattatcgctttgatgaaataagagaacattttgggcattaaagaatgttcctaattgtctaagaatattatcaaaagcattttctcgttgaatatttttatctatatttttccagcttatttctaaaaattgttgtaaatctgaatcctgattttcatatgctaagttaaagggaatatcctgcatttcaatttttcttacagtatcgccctcataatgagacagctgttctttaacatacataagtttatcgattttggatacaaaacattcacgcatatttgtttgttcaaagtcgatttgttgagaacaaaatgggcacggtgatttacgattatgtaataattcataacattttattggctttttaactgggaaaatacaattaaatatgatttgtccagtcgggctcatcgataaaattgtaaaatcattagggttaataatcatttcaatcttgaaattaaattcaactttttcaatttcttgataagatagtatctggttttttccgcgtcttttagctgtatctaaggcatggagtgcgcattgatgaatttgactatagctcatattttctgaaaatagatagattaaaccaccggtgagagttaactgggtctcaatatcttgaaaatgataaatactagaaagctttttttgaagttgtaaggctgcttgatagataactttttttgattcagcattatgataaaaaatagagaatgtatcaccattgattcgtgctgcaatacagctggaagaaatacttttcttgatcatttgtcccatttgacgaatgatttggtcaccgaacaagaaattcccactgtgatttatctgtttaaaattatcaatatctagcaaaagaaaagcattgactttcttaggatcatattctttcttcagcaatgtttcaatcattagctgtgaagtagactcattatataagctactcatctcatcaatttctgctttattttgcaatgctaattcacgtcttttttggatatcaatatttttggtataaataaataatattacatcgttattttgaggagaaatagttgttttcatatttaaggatacccataatatcattccatttaaatatttctgcctaaattcaaaagttggaatatcggtaaaagtacggatatagtcattaatttgatttttagaatattttttctcaaattttttttgatcatcctcattagcaatagtctgtaataaatatttataaatatcatcgtatgtgtaatcagagagctgtttttcatactgttcattggaatgtaaagaaatatcttcgataaaatcacgagaaaaatttaaacggatgtttaatataatatcttcattcaaaactttccttaaactttcttcattatagattcttgtctcaatttttttttgttctgtaacatcttctgatatgccaattgcccatgctggtttttcatcaatatgctggacaatagtatatgttattttttcccaaagatatttatctttcgcatctttttgtttgaccctgattgtagcagaaaggggagcagctcctttttctaagcgttgatataaattcttaagttcattaatgctttgaggatggatcaacccttgtgcaattatgctttctgggatattggcagtaagattttgatagctgcggattactgcagaatcgggattgccaattacttgtttgttttgaatatcaaactcccaaatatttaagccggttttagtttgtgcaactttaaacaactgctgtgagcgatataacttatcttctagtttttttcgtttagtaatatccatgaccattccaatcataataattgtttgatcaagcagcgaagtaaagctggcactaatatgaatccaggcaattgaattgtctcgttttttaattcgatattcaagaatagcttgtgactgattatttttaattaaatccgttatttgggctcttattcttgctttatctgattcataaatgagattttcagcacaatcatttaaatcatggtgaaattgctttttggtatacccatgtattcgataatatccgtcattagcatataaaattggaaaatgttcaattaatgcagctttaaaaactccgtcaaggctattttcattaatgaaacgtagttcttgttcattattcatttcatgggaaatatcaacaaaaaaagacaaaattaatttttgaccatgcccatcgataacgtattttcctctttcatatacccaaagcaaatggcctccgtggcaaactatgcgataacgaatttcataaatgtcatttctttcaagctgttggaaaatttctctttcaacaaattgacgatctttttcatagataatatttgaaaattttccatttgttatttgacataattcttcataagaatattgggtatattctaaaatggcttgattaaagcaatagagtggaaagccagagtgcgcttggacagctagtattcctcccgggatatttttatttacaaaatcaagtaagtcagtttttgtttttaaatcattttgctgatcaaatatgtttacaaagtaaaagcttttttgaaaaagaaaattatttttattgctttgatttttctcataaatataatacgaagtatctaaataagtatctaaagaatttggctctagagaagcttgttctctatttttatctaaattacgaattgttccagcaaataaatctggattaccatttttatctctaatcatttttcctttacaaagcaagggaatccaacggttagaggcatcttttgcacgataataaattgtatgctgttcagctctgccatcagcaatttcttgattacttcttaaaaatcctgctttatcatcaggatgaattttttctccccaaaatgctgcagcattatcaagaatttgatttggcaaacgaaaatctatcatcatctgacgtgagtacatgaatttacttgtctttaaatttccaacaaataagtagtcatcaattgtttctgataaactttcaaaaagatgatcacgattatattcaaataaaggaatagaattatacttaggttgtgaatttgttagcctttttttattcataagaatatgataatctcgtttttggatatacatttgtgaatcagcaatagataatacatcagaaacagttaaattttcatctacatggatattagcaattccataactaaaagaggtatcataatcaatgttttctttgattctttcttgatttaaagttaaaagaatattatccatccaaacttctacacctttaacagtagtatctaaaaaaacaattataaattcatcaccactaaggcgaaagataaagtttggctctttcaaacgcttttttatattttgggcaacaaatattaataggcgatcgccttcaagatgtccataagtatcattaacccattttaaaccgttcatgtcatataaaactacaacaaagtcttcgttaagatattcagcagttaatagttcttcaattcgttttttaccggcatttcgattaaaaatacctgttaattcatcaattgttgcttctacagataactgtagttgttcagtaacgtcaatcgaattttggatatgataaagtttgttatcccaaagttctaaagtatcatgatttaaatatgttttttctgttaccgtgttcttttcataccatacacaaattttttgtgaattagattcttgaagttgtttgattttacaaaactcacatcttttgttcattccagattgtaaaatctgccagcatttctttccttcggtgttagagacttgaaacgtatttttcatataatcgttcatatatacaatttcatcagtttcaacatcggtgacatagatattagagttaatttgatcaagaatcttcttgtagaatgctgaattaaaattttcattcatcgacaaaatcacctcaattatcgtttatatatattacttttattatatcattcatcgagaaacatataaaaaaattaacaagtaaaaagataagttaatgtagttaaaatgtgattttgtaactgatttataaccaatttatgtaattttatggaaaatttaattactaaaaaataaatattaacaattaaagtagaaaaaactgatttaataaataaaaagggctataacgcctagagtgatatgcttcctcctaggtagacaaataaaataataaaaacttgtcatctagaagggaacatatcaaagattgaaaatctttatttgttatagtcctttaagcttgtctttttatgattgtgatatttctgccactatctttatatttacgatagctataaaataacttgtcattttcaacagtacaatatggcgaaacagtaatattttttttcaataaacctaaatttaataacatttgtcggtttagacctttgttatcaagcaaataatgtgtagtatctgtttgtttatagtacggagtagtatcgaaatccatttgtttaactaagtcgatgacattatccattacctcaagacaatcttggcagatgcatggtccaatataggcaagcatctctttaggatcacaatgttcattttcaattagatgttttgtgacttttgaaacaatttgtttagttgttcctagccaaccagaatgaattgcagcaattatttttgttttaggacaatatagtaacactggggtacaatctgcatgaaatgataataaaaagagatcagtatcttttgtataaagagcatcagtattgttaaaggcatcatcttggcagtacatacctctgccaccgtctttaagagatacttctttaaagttggctgagtgtgtttgatgtggtgccaccatgtgctctaaatcagtttttaaaagtttggctaattgtttacgattattgagaatcaattgtttgtcctcgttattataagacatatcgcctaattctttagtaattgtatatgcttcaatgttttcaacagtattccatttgattaatttcataatttagacctttctgtgtaatttgccttagcaccaaatttaatcgaacatatagtatattaaaggaggtggaaatgatgttttgtaactcaggatgtggttgtaacaacagctgcggatgtggaggatgtaacagtggaatgaactgctgccgtgctactccaatcgttgcaccaagaaaagtttgtacaagctgctctaatcaatatgttgaacaaccaattatttgcccaatcgaatgtcgccatattaataatatcgtttattacccacgttattatccacgttatgaacgtactttcatgactcaaagtaatggaaatccattcgcaagtgctgctaacgctactccatttaacggagcaggtacaggatttaacgcagctaataacacaggtgactctgttattaatggaatgtataacaacgctaataacggaggaagcggatgtggatgtaaccgctaaaaaagatagatgcccaggcatctattttttttgtaattcatcgaggcaatgttgatcaggatcaatataaatagttttataattatctaagattacttgcccaggtttagcgccatgaggctttttcaatgtttttattaaagtataattgacaggaacactactactgtttttcccttttgaataataggcagcgatattactagctaatcgaatcgtatattcatctaattgatcacctttaacgacaacatgactaccaggcatatctttaacatgaaaccaggtatcatagcgatgagcatgtttaaaagttagataatcattttgaaggttattcttcccaatacatatttcaataccatctttagtataatatgtctcaaaagaaggttttttatttttacggatcgtattagttttctttttcttttttaaatatcctagattttctaattcttcttttatttctagggcatcatagtatgaagcattatccattagtgttaaaagactgtcaaaatattcaatttcttttttggttaaatcaatctgctcatgcagaacattgattgaattttttgccttttgatacttgttataatatttttgagcattacttttaggatcaagtttttcatctaaatcaaccataatcttagaaccatcatagtaattatctagttcaatatgacgcattcctttttttaataaatgtaagtttgagtataaaagatcgccaatgattcgatattcatcactattgttcgaatcttctagagttgattctaattttgcaagtttagtaacatttttttgatattcattattaataaatttcaaaagatttgatgtttgttgttttatacgttctttttgatcgattaaattaaaatgtttatccagaccatcgaataatgaataagactgtgcctgctgatttagatgagttaatggaattaaatgaaaatattctttttcatcaactctacttatataaagggtatcgctattttttatttcatccataatctctttaaaatctataccattatcatgacgataaagaatttctttagataggattggagacatcccttgatatatttttgttagattattgttttcaataaaatcactagtgaaaggatcaactttattttgattcattggtggcaattggtacattgcccctggttgtacaaaacgttcactattaatgttaggggtaattcgttttaaacaatcaagaatttttttatcttgattgcaaagaataatattagaatgtttacccataatttcaatataacaatggtattcaacgtaatcaccaaattcgttatgacagccaaaaagaaaatgacaaattcgatctaattcgatttgttcaatttttttgatataaccaccctcaagatgtttacgaaataacattgttaaaggattcggactttccggagtaggatagtctaaattagtcagctgaattcttgcgtacattggatggcaggagagcagcagcttgtaattagttcgattattacgaacttgaatcaataattcatattttgagatttggtagattttgttgattctaccaccagttattgttttgtttaagtcatcaattacttgatgcatcattattccatcatatgccattttttatcaccgttgtaagtataacatagattaaaaataattgacattatatagtttgaaaacaattgacaatataagacgtattttgtatgatgaacttatcaaaaaaaaggggtgtagacagtgcaaaaaggaatgttgataattcttagtgggcctagtggcgttggtaaaggaacagtaagagaagaattattcaaagacgatagtttaaatcttgcttattcgatttcgatgacaacaagaaaaccacgtccaaatgaaagagatggaattgattatttttttgttgaagaagaagaatttaaaagtaaaattgaagaaggaaagttattagagtgggcgcagtttgtcggtaattattacggaacacccaaagattacgttgatcaattattaaatgaaggtaaaaatgttgttttagaaattgaagttcaaggggcccttcaagtaatggaaaaatgtccagatgcaacaacaatctttttagtaccacctagcttagaagaactcgaacgacgaattcgtggacgtcgtacagaggaagaagagattgtccaacaacgtttatcaaaagcaagaaaagaaattgcgactaaagatgaatataaatatgtagtggaaaatgatgacgttatggcagcaaaagataaaattgctgaaattataaaaaatcatcaaacaaatcaggggtaaatatccctgatttttagtaggaggaaaaatggaaaagtttaaagagtattttaaggtgtttgcgtatattttttatccaggaatggttttaattttatatttggcacaagggttagaaggtaaattaggacttgatttaattttttgcccaaccgacattattgtgttattagctattttgggaatatacatgttgttagatgcatttaaagtatttaatgctaaagtgtttgattttatgaaaaaaaatgatggacggctaaaagtgccatttttactagcttttttattaattattgcagttttgatgggactatatgatgatttaaaagtatatttttatttgaataatgatgtaagtattaatttatttattataatcgcattaggtttagggttagcaggaatagctttcctcttaaataaatctgaaaaataagttataatatggttgctaagataaaaacacgaacttgttggtagtcaagttgtgcattttgcatcagtaacctgccctcctgaggttgtccgttcttagaagtaaatttcaaggaggatagcgatatgttggatgttggtttggaattaaatgttttatttgatgatccgttttggattggagtattttatttaacaaatggagataagtgttacgttgaacgagttgtgttcggtcaagagccaagtgatggtgagatatatgtttattttttaaataattaccataaacttaattttgttgctgagttcaaagcgaaacataaagataaaccaaaaaatcctaagcgattacaacggatgattagaaaacaatctatgaacttacaaacaggtactaaatcgatgcaagcgttgaaacgacaatatgagcaaaataaggcaaagaataaaattattcgtcgtgagcagcgaacggctgaaaaagagcatctatttgtattgaaacagcaaaaacgtaaagcgaaacatcggggccattaggcccttttgttacaatttcccgggaaatgtaaaataatgaggtaataaaatggtcaaacgagtaataattggatttggaatattgaatctactagcatttttattagtatttaaaaaaccatataaaaaacagcgttataaaaaatatgattgtgcgattatttgtggttatcctgctaatatcgatggtgagccatcaacaattatgaaatcacgggttgaaatgggtgttactttatataaaaaagataagattaaatttttaatcttatctggtggggcagttaaaaatgaatatcaggaagcgaaaataatggcttcatatgcaattagtttaggggtaaaaaaagaagatatccttatcgagggacaatctcgaagtacatatcataatttgatgtatagccgcgatataatgcagataaatggattgaaaaatgctctagttgttacaaatagctggcatttacgaaaggcagatcattatgctcggaaattcaaattagattatgccatggtcagtgcttcagcaccgaaatcatactgttggattaaagtcgtggttctgcatctaggaactaatataaaaatgtattacaatttattcaaaggatattattaattatttattcagatatttattattttcaaaaacgagtggcaaaccgtcattttcatctcctttgagatcgtttcgagttaataaatacgtttttaattcacttcggctattaaattttgtcacctgataaggataaaaacaaccgtatttttcaataaaatataaaccgtcattgctatcaattaaaacaccacagtggctaacaaagcgacggttatctgcggaagagtgaagccacaaggtaatcaatgatgctttttggttttgttttacgctaaagtcacgatcactaaatgttttttcaatttgattgatatgagaaatttcattattttttatgccggtaacagaaatgctgttaaaagtagtaatgaattttaaacgatcttcttggctcattgaatactgatcaatagtatcaattaaatttaaattaaacataatatatgagtcatctgcgtgaccgctattattagtataaattaggttttttattaagataaatgaaggaattagtgaattagaatcgttttgatcacttatttcaactgggctattatatttaaaatattggtaatctggttgttctctttctaaagtttcaaaatcaccaattaagggtgtagcgtgctgattaaaggtattaacataggaaaagaattgtttaatattctctttggggagatcagcttcatttaaaatattagtaagtttattttgactggcttgattaccaagattgctatataaaattggcttgtctttagagcatcctgttatcataagcaggcatagtaaaattattgatagttttttacacataaacagccccccccttttatctaaattatatagagtatttttcttaaaaacaattatctatatcttaatattcattaagtctgtgatataatatccttataaaaagggggatagtataatgaatgaaacaatcaataatttaattacacgtcgaagtgttcgaagcttccaaaaagagcaaattagcgaagaacaattgaatgaaattttgacggctggaacatatgcagcctcaggaatgggacgtcaatctgcaattatggtagttattcaaaatcctgagataattaagcggctatcaaaattgaatgcggcaataatggatagtgaaaacgatcctttttatggagcaccaacagtggtagtcgttttaggggattcaacgattggaacatatttagaagatggtgcgttagtaatggggaatcttttaaatgcagccaatgcagttggcgtagattcttgctggattcatcgtgccaaagaagtttttatgagtactgagggaaaagaattgttaaagcagtggggcattgatgaaaagtatgtaggaatcggtaattgtattttaggttatggtaaagaaccgaaaccagaagctaaaccgcgaaaagataattatatttatcgtgtctaggaatcgcaaagattcctttttttaaaagagagtgaatgcaatgaagtatgtattaactcatgcaactgtttttgatggttatcatgattatgtgttgaaacatgatcttaatatctatcttgatgaatcatcaataaaagcttttagtgtcatcaggctagtttaatttgcactttattaccagcggtgttactcgctaatttttcgctagaacagatgtttgtggtaagatgatagatcatccaaaaataaaaaacgtgggagagcaattaaatactttgctataaagatataagagttaatcgactcttttattttatcttgtagatgtggtagaatagaaacaaattggagatgatgatggtgtatattgtacaagtattagtagaacatccaacccatgctcttgacactacttttgattatttagcaaatactgaaattgctagtggggttagagtgacaattgcgtttggatatcaacgaataatcggatatgtaacgggatgtcgttatagcaattcaacaaaagaggaattagaaacagcagcaggatttaaatatcgctatattagtgaagttattgatgagcgccccttattaaatcaagaattacaagagctgtctttgacattagcaaaattaactttgtcgccacgaattagctgtcttcaagcaatgttgccacctcaattaaaaccaagtacaaataaaagtgttggaattaagtatcaaaaagtaattaaagttattaatgaagatgctactcttaaaactgttaaacaacaagaagcgtatcaatatttaaaaacacatcccgacacgccactaaaagcatttccttatagccgtggactgcttgacaagttaattgaacagagggtaacggtaataatcgaacaggaattatatcgtgacccttatttagatgatcaaaaagaggaacatgagttttctttaactgttgatcaacaaaaagtagtcaatggaatcatgagcaaaattgatacttatcatactgctttaattcatggtgtgactggttctggaaaaaccgaagtgtatctacatttatctaaatatgtgattagaaataataaaactgtcttaatgttagtaccggagatttctttaacaccgatgatggtcaatgcttttaaacacaaatttgggaaagaggtagcaattttacattcaaaattatctgctggtgagcgttatgatgagtatcggcgaattttgaatagtgaagttaagatcgttgttggtgctcgaagtgcggtatttgcgcctttggaaaaaataggattgattattttagatgaagaacatgatcctagttataaacaggaaagcaagccacggtatcaaacgactcagattgctcgaattcgggggcaataccataactgtcccgttattcttggtagtgctacaccgtcactagaatcttatagtcgaggacaaaaaggaatttatgatctatacgagctaccaaagcggatcaatcagtttcccttaccaaagattgaattgatcgatatggctgatgaaattagaaataaaaattattcacttttttcaaaagcgatgaaggaacaaattcaaacctgcctggatcatgatgaacaagtaattcttctattaaataaacgtggttatgcaacatatgttcgttgccttgattgtggtgaagtaattaaatgtcctcattgtgatgtaaccttaacatatcataaggcggatcacaaattacgttgtcattattgtgaacatcaaattgaaatgccgcgtctttgtccacattgttcaagtgaacgattaaaattagttggagcaggaacacaaaaagtagaggaacagctggagactatatttgatggtgcaaaagtgattcgttatgacgttgatacaactaaacaaaaggatgggcatcaaaaattattagataagtttgctcgcaaagagggtaatattctattaggaacacagatgatagcaaaaggattagattttgaaaatgttacttttgttggtgttttaaatgctgatataagtttaaatatccctgattttcgtgctaatgagcgaacttttcaactgcttgaacaggtttcaggacgaagtggacgtggtcaaaaagaaggtacagtaatgattcagacatacaatcctgagcattttgtgttacaatgtgtcaagaatcacgactatcttcgtttttatcaggaagaaatgaaaacacgaaaattagcagcttaccctccatatgttcatttagtgagcattttaatacaaggaaaagatgaagaagttgttaatcaaagtgcggtgcaaataaaagagtatttacaaaaacaacttgataaaatggcaattcttggtccggcaaatagtttgatctatcggatgcaggatatttatcgtaaacgtattatgattaaatttacaaatagtaaacaattatatccagtattagaaaagatgagtgatttttataataaaaaaggaaataaagttcatgtggtttgtgactttaatccatataatcaaatataggaaggactatttatggcaagaacgactgcattagatgtattaataaaataccaaaatgagcaaagttatttaaatattactttaaatgactatttagaaaaaagcttattatctagaaatgataaagatttggctacacgaattgtatatggaacgattcaaaataagttatatcttgaatatcaattggcgccatatattcaagggaaaaaaattaaaaatcgtgagaaaatgattttattgatgtcattgtatcaattaattttcttagataaggttccggattatgctgtaattgatgaagctgtccgtttagcaaagaaacgtgataattttgcggggaaatttgttaatgctattttaagaaattttttacgtaatggaaaatgtgagattgatgagaaggatgaattgaaaagaatttctattgaaacaagccatcccttatggatagttaagatgttaagtaaacagtatgatttaaatatagccaaaaagatttgtcagcatgataatacaccaccaaccagagcagcgagggtcaatattttaaagactacaaaggctcaattattaactgatgaaaattttgaagcagggaatctttctcccgatggactcttgtacagagcaggaaatattgctaacactgattattttaaaaacgggttagtcactattcaagacgagtcaagtcagttgattgctccgttgctggatcctcagccaacggatctcgttcttgatatgtgttgtgctccaggaagtaaaactacacatttagcagctattatgaataatcagggtaaaataattgcatatgatttatttgaacataaaatcaagctagttgaagctaatctaaaacgcttaggtgttaataatgtagaactgcatgttggggatgccactttgttgaaagaaaaatattcagaagaatcatttgataaaattttgcttgatgcaccttgcagcggtttaggagtaatgaaacgtaaaccggagattaaatatcatgattctggtgcaatggatacaatcattcctttacaagcaaaattgttagacaatgcctactatttattgaagaaaaatggtaaaatggtctatagtacgtgtacaatcaataaaaaagaaaatgaacaaatgataaaacaatttcttgataaatatccagatatgaagataattgaagaaaagaagattttaccgtatgtttatgacagtgatggattttatatgtgtaaattagaaaaaggaaaataagatgaaaaatatttatgattattcactagaacaactaactgaatattttgcttcaatcaaacaaaagccattccgtgctaaacaagtttttagctggctttaccagaaagatgctcgtagttttgatgatatgtcggatttatcaaaagatctacgaaatcaattgaaagtagaattttctttagatgttttaaaaattaaagaaaaacaagtagcaagagatgggacaattaaatatctgttcgaattattagatggaagtttgattgaatctgtcttaatgattcatgactatggtaagtcactatgtgtaactagccaaattggctgcaacatgaaatgtacattttgtgctagtggtttattacgcaaacaacgtgatttaacaccaggtgaaattgttgcacaaattattaaagtacaacaagatattgatcaacgagttagtcatgtagtcgtaatggggacgggtgaaccatttgataattatgataatgtgatggaatttgtacggatcattaaccatccacatggtctagctatcggcgctcgacacattactatttcaacttgtggattgatcaaagggatcaagcaatatagtgaagaaggaattcaaactaatttggcgatttcgttacatgctgctaatgatgaaattcgcgatgaattgatgccgatcaataaggtgcatccaatggatgatttacgtgaagctatcagtgaatatattgataaaacaaatcggcgtgttacttttgaatatatcatgttaaaaggtgttaatgatgatattgtttacgctcgtcaattggcacactatctacgtggattaaatgcatatgttaatttaataccatataatagtgttgatgagcatggttatcaacctagtgataaagaaacagtagaaatatttaaaaatgagctattaagattacatattaatgtaactttaagaaaagaacatgggcgcgatattgatggtgcttgtggacaattaagggctaaaagaagtggggtgaaataatgaactattatgcattgactgatatcggtaaagtacgaaataaaaatcaggatcaggctactgttattgcaaatgtaaaagatcaagttattgcaattgtctgtgatggtatgggtggtcatcgtgctggtgaaattgcttctcgggtggtgatggatcaatttgttaattgttttgacagtatccccccatttgataatgttgatgagttgaaaaaatgggtaaatgaaacaatttatgaagctgatgcgattgtaaaaagaatggctaagcaaaatgttgagcatcatggtatgggtacgacaattgtcgtggcaattttaatggataatgtgatatatatttctcatgtcggtgatagccgtgcttatgttttgaaaaatgatcaattaatgcaattgactaaagatcatactttagttaatgctttagttgatcgtggagcaatcagtgaagaagaagctgttaatcatagccaaaaaaatgttttgactcaggcaattggtgcagatactgaattaaccccatcttttatcgaattagaatttgcagatagtttattgttgctttgcagtgatggattatataattgcttaaatgatgaaataattaaagaaattttaaaaaagaatataaaagtatctcaaaaagttactgaattaattgatcgagctaatgaaaatggtggacgtgataatatcggagtagctatcattgataatcgggaggaaaaataggatggcaaaaataattgcagaacgttatgaattgttagaactaattggtcaaggcggaatggcagatgtttatttagctcaagatattatcttaaatcgtactattgcgattaagattcttcgaactagccttgctaaagatccaatatatgtaactagatttcaacgtgaagctagtgcagcagctgcactttctcataaaaatattgttgaaatatatgatgttggtgaggatgaagataaatattatattgtcatggaatatgtgccgggtatgacgttaaaagagttgattttaaagcgtggtgctgttcatgtagttgaagcaattgatattatgaaacaagtaattagtggaatttctaaagctcatcagctagggattatccatcgtgatttaaaaccgcaaaatattttggttactgatagtggagtggctaaaattgccgattttggaattgcttcaatgcaatctctagcgcaggtaacccagacagatgttattatgggctcattgcattatttagctccagaattagcacgtggtgaaaaagcgactgcccaaagtgacgtatatgctttaggaattgttttttatgagttgttacggggagaagtaccatttaatggtgaatcaccagttaatattgcattaaagcatatgcaggaagatctaccatcattgttggagtttaatccttcaattccccagtctgttgagaatattgtaattaaagctactgctaaaaatcttaatgatcgttataaaagtgcaacagaaatgttggatgatataaagacttgtatggagcgtcaggatgaagaaaaattagttttttcacatgaccaagatactgatccaacaattgttattgatcctcgttccgcatttactagtggcaatactgcaccaatcgtagatccagttgaagaaaaagaagtggcagcccctaaaaaagaaggttttttcagtaaattagttaataaatttaaaggtttagatacaaaagctaaggtggcagttggtgtggttactgctttagttatcgcgggaattgcttttgcgatttatcttggagtgaagccagatactagtctaatgcctgatttaacagaaaaaacagttgaacaagcaaaagaaattttaaaagaatataatgttactattagcgatgatattactgaagaactatctgatgaatatgaaaaaggtgaaatcattgcaacagaccctaaaaaaggaacgacgatcaaagaaggtgatgtcgttaaagtaacagtatcgaaaggcaaatatattgttcttgaagattacactggaaaaaaagaagatgttgctaaaaaggcattagaaaaattgaaatttgaagtagagattgaatatgagatatcttctaaaactaaaggaactgtaattgatcaaagtattgaaaaaggaactaaagtagatccaactgaaaaagatcgtaaaattattttaacagtatcaaaaggtgattatgtagttcttggtaattatgtaggaatggatcaaaataaggccaaagaagcactgacaaaacttgggtttgatgttacgatcaaagaaactagttcagaacaagcagttggaacagttgttgaacagagtttaaaagaagggcataaggttgatcctgatgaaaaagatcggacaattacattgactgtttcttcgggaattaaaattgaagtaccaaatgttaaaggaatggatattgatgctgctgcgaccttactaacaaataaaggtttttcagttaaacgggaaacattgccaacacctacagatccaaatgaaattgaaaagattactgtaaatcaagtagtccgtcaaagtttagatgcctttactacggtaactaagaagaatgaatctattacactttattattataattataaacctgaaatacctacagatgattaggaggtagagatgtcacaaggaagaattattaaagcattagcagggttttattatgtcgaagatgatcatcaaataattcaatgtcgtgctagggggaaatttcgtaaggatgagattaagcccctggttggtgactttgttgaatatgaagtcgaaggtgataatgatggctatgtaatgaatgtattgcctcgtcataattgtttagttcgaccacctatttgtaatgttgatcaagctctgattgttagttcttgtaaggaacctgatttttcatcaatattattagataaatttcttttagtaattgagcatttaggaattgaaccaattattattatttctaaaatggatttagatgaagataaaagcgttaaacaatatgttaaagattatcgtcaggctggatatcgggtatatgaaataagctcaaaagataatcatgggcttgaggaattaaaaacagtctttaaagataaagtatcagtgattactggacaaagtggggtaggcaaaagtagttttttgaatgccttagatattaatttaaaattggaaacaaatgagatatcaaaatctcttgggcgaggaaaacatacaactcgtcatgttgaactgctcaagatgtatggtggatatcttggagatacacctggtttttcttcattagaattggaaatgacaccggaagaactagctgtagcctatcatgattttgctcaatttagtcatgaatgcaagtttagaggatgtttacacgatagtgaacctaattgtggggtaaaaaaagccgttgaagatggaaaaatatctaaagaacgctatgagcattatttaatgaatttacaagatgtaaaaaagaaagaggaacggaagtatggttaaagtagcaccttcattattatcagctaattttgcttatttgaaagaagagattaacgcaatcaaagcggcagattggattcattatgatgtaatggatggacattttgttccaaacatatcatttggatatagtattttaaaagatgttagtaaagtaacggatatgtatcttgatgtacatttaatgattactgatccagctaaatatgtggataattttattaatagtaatgcgtcattaattgtttttcattatgaagcagttgctgaagataagattaatgaattaatcgctcatattaaggagcatgatgtggaggtcgggctatcaattaagccggatacaccagtagaagtactaaaaccatttttgaatgagttagatgttgttttagtaatgtcagttgagcccggttttggtgggcaaaaatttaattcggcagctgttgataaaattgcacagctggcaacactcagaaaagaaaataattatcattatttaattgaagtagatggaggaatcaatgaatcgacttccaagttatgtaatgatgctggagttgacgttttagtggctggcagctatgtttttggtagtgatgattatacgaaagcaatagagtcactaaaatgaagataggtatttgtagtgcactggcttgtaaactcgatgacagtttaaaatatattggtgttgatcatggtgttgaaatattacttaaacaggggattaagcctgtctttgcaattggtgattttgattcgattgaaaacgagaatgttttaagtgagttagatatagaaagattgccaactcgtaaagatgtgaccgatacacatgcagctttagaatatgctttggagaatggttatgatgaagtagatatttatggtgtgacgggcggtcgtttagatcattttcttagcgttatgtgtcttttggaaaaatatgcagataaaaaaattagaattattgatcagcaaaatgttattcaattattattgccgggaacacataaggtgtatcaagatgaatataagtatttttcattatatgcactagatgatgcttatattgatattgatggtgctgagtacccattgaatcagtattttttacaacgacaggatccattatgtgtatccaatcaagtaagttgtgaaattgcaactatcacaaatagtaaaccaatcgttctggttaaatcaaaagatgcttgataaattcattttttgtaatcgctttcttgacaggggataattgtcatgatatactcgtgaagtaaatggattgttactattagattaggcaagaccgatgtacagattattttctgtatatcggtcttttatttttctaatccatttgactaaatcttagggaggaaaaaagatggcaagattttgggacaaagctttaaaatcttcattagcaatgttggttgtatttagtacactattttttatgtcaccaaatataaaagtagaagctaaagaaacaaattatgaaatttatccaacaccacatgaaattacttatcaagataaggattatgttattcgttcacaagttaatgtggtatatgaagatggaattgatgctgctactaaaaagagaatgactgaagtattagagtcaaaaaataaacaaattagcacatctaagcagaaagtagacggaaaaacaaatattttagttggtacatataaatctggagggtatgttgatggctatgttaaatccaactatagcgttgaagagagtctatttagtaaatttggggcgcattttgttgcttcaaataatggtgaaattgttattttaggaaaagatactgatggggcattttatggaattacctcattaaaacatatttttaatcaaatggatggatcaacaatccgtaactttgtaattaaagattatgctgataccgatattcgtggttttatcgaagggtactatgggattccttggtcaaatgaagatagaatgtcattaatgaaatttggtggtgatttcaaaatgacttcttatgtatttgcacctaaagatgatccatatcataaaaatttatggcgtgaattatatcctgaagaggaactcgcagccattaaggaaatggttcaagtaggaaatgattctaaatgtagatttgtatggacagcccatccatttatgggtggtttcaatacatctaaagtagatgaagaaattgcttcattacttaaaaagtttgatcaattgtacgatgctggggtacgccaatttggtgttcttggtgatgatgttggtagcctagaccgtagtgttgtaattaaaatgatgaatagtgtatcagcttgggcaaaagaaaaaggagatgtttatgattctgttttctgtccagcaggatataatcattcatggcaaggggattattctgaattaagtgattatgatgctggattccctgaagatgtgaaaattttctggactggtgaagcagtgtgtcaaccagttgaacaaaaaacattagatcattttaaaagaaacagattaccagaaggggctgacgaaagaagaagtccactgttctggttgaactggcctgtcaatgatattaacggttcacgtttaatgatggggaaaggaagtttattacacactgatattaatattgatgatttaagtggggtagtaactaatccaatgcaagaagctgaagcttctaaagtggctatttttgcggtagctgattatgcatggaatgttaaaagctttaatgatgatcaaagttgggctgattcatttaaatatattgatcaagaggcaagtgaggaattacatacattagctaagcatatgtctaatcctcaacctaatggtcatggcttagttttagctgaatctgaagaattacaaccattaattaatgagtttaaaactaagttagctaatggtgattcaattattgagagtggaaaacaattaattgcagaaatgaatgtgattattgatgcttgtgatggtttccatgcaaatagtaaaaatgaaaacctgaaaaaagaattattatcttttaccggttctttaaaagatttagcgacagcaattaaacattttacagaatcagcaattgcaattgaagaaaatgatatggttacagcttttaatcaattctcaaatgcatcatcagaattaattaatagtcaaaatcatatccgtaaattattaaatggaacagctaaagttagtcctggatcaacacatttgattcctttggcaaaagctttacaagataaactttcaggaccaattaatgactatattgctagtggagaaacagaacaaccattagaaattagtgcttcatcaagctttactacttggcattcaggtaaaatagctgatattgttgatggtaataatgatactgcagcatggcataatggatatgaaaaagctggtcaatatttccaagtggatctaagtaaaccaacgactatttatggtgttcatattttaaatggtgctaataatagtgataaaaaagaagatacttttggttatgcaaaattacaatattctactgatggaacaacttttaaagatttaaataaagaagtatatggtgaatatgcatcacaagtagatgttactaatattgaaattgaagatgttgttgccgtacgttatgtatgtagcgaagttggtggcggaaacaaatggccggcaatgcgtgaatttactgttgttacacaaccggcagaagaggaacaatttactaaagaagtgatccgtactacggatggatggagtatttatggtggtagtgatgctaatcttattgatggtgatttaactactaaagtacattataatgttagacaaaaaggggaacctgcaaatacaactattccaggtgattatgtaggggttaaattatctaaaccaattactttaggtaagattaatattcttcaaggtaacactgatagcgatggtgattattttaaagatgctgatttacaatattcattagatggtaaaacttggacaacagttgaaacatataaaaatacaattaatattgtgactgatttgtcagatcaaaatattactgctcaatatgtccgattggttaataaggttaatcaaaacacttggattgctatgcgtgaatttgatgtagcagctaaggtatatcataatggtaaagtatttactaatgttagtgaatataagagtttaactgctgattatttagatgaaagtgctaaaatcacgccagctaaagggattactttagctaatggtgattatgtaggtttaaaactagatcgaattcatgaattaaaagatattgttagtgaattaacaaatgatagtttgaccattcaagtttctaaaaatagttatgagtggcaaaacgtaaatgctggtaatgtaagtgctgatgctcgttatgttcgtattattaataataatgaggctgaagtaacttttgatcttaataaatttattgtaaatacagttgagattaaagagaaatcaattacaagtagtaatttttcaatcgataaaccattgaatgtatttgatggtgatcttactacggctactgcttatcagggatcacaaaatgttggcaagtatttcacatatgatttaggtcaagaaataactttaaattcatttaaagctatatgtactgatagcgaatgggattatccacgtcatggaaagttctcagtttctactgatggtgaaacttggacagaaatcatgcttttaggtaatcaaaatgaaaataacccaggtgaagctgaaaatactgatgaaattggttttgttttaccaagtcatgaaatttcatataatgcaaaaaaagtagatggtttaaatctgcaagctcgttatttaaaatttgaaattactagaactaaagttggagctgataaatgggttagattccaagaattagaaataaataatggggaatttataccttcacaaaacaatccaacctttacatctagtagtcaagaaacaagagatggattatttagttatatggttgatggggatatttcaacaatgtttattcctaaagatgctaatggttatgtgaactatagtttatcatctaataaccaagtaaacacaattaaaattattcaaaatagtgctgtaatttctaatgcagttgttaaagcaagattatttacaaatgcaagtgcagaacaatgggtaactttaggaacattatcacaagcaattaatgaatttgttttacctgaaaatacaatcttattagatattaaggttgagtggggtgatgtgattcctaatattacagaattatcaacatataaatctgaggtcactacacttaatgttgatgcgcttaaagctttaattgataacaaggaagatttatcttcatggacagctgcagcagctgcaacatatggagatgcttataatgcaggtaagcaagtacttgaaagtgagtatgcttcacaaacaactgttgataatgccgttagagcaattaataaggcaattgaaaataaagtattaaaaggtgatttaagtaaattggaaataattatcgctaatgcacatactgatcaaaataattacactgcggcttcatggttagcatatagtaaagctattgaggcaattaataagtcaattgctaatggtgataatacttcagttgcagatgttgataaattaattgctaattatgatctagcaaatactaatttagtatttaatccttcaaatcaagaagaagcaattattacaattgaaggagaaaatgattttgtagcttcggttacaaatccagaaaaactttacacaatcaactcatggaaaatgtatctagaagctaaggcaaaagttgaacagttgattatagataatcaaagcactcctgtacaccctgatgaatttgcgaaagctattagtgaattagctgctgctaaagaaaaattagtagttgttggtgatctaaaagatattttagatacagctaataaagttaatcaagaattatatacaactagcagttacaaaggattagctgatgcaattgctgaagcaactgcaagattagaaaatggaactgctgaagaaattgatgctagtgtcaaagcacttgataatacacttaaagctcttgtagttcgtgctaaagctgatgaagtaaaagaatatattaacagtattacattagtggatttaagcaaatacactgacagttctgctaaaatatatcaagaggcatataatgttttaaaagctatgcttgataacttaagtgatatttctgctaaagaatttattgaggctaaaaacaattttgaaacagcggttgctaaattagaagaaaaagcaacagtagccccaataccaacaccgactccaaacgaacttcctgctagtgattctgcgaaaacaggtgatgatgtaaatatttttgcctatgtaacaggattaggcgttgttgctattgttggtatatactggctgttaagaaaaaaagaggaataatttaatagatgttaaaaagcgaaatttaaatttcgctttttatactgtaaataaaaaacgagcctaatttttgaaatgaggccccttatttggttatccaaataaggggcttcatttaatttagactcaatcatttataagtaaaaatggttttaccagtttcaacagatgaagcagtagtaaatgttttaatagggtgagattcatagttgcaaacaataataggggtaataaccttattatttaggacttttaataaattatcgcttagtgtaacaatatctgctcctaaagaaacatagtcaccggcttttacatgatactgaaaattattagcatctggctttgctctattgataccaatatgtactagtaaatgaagaccattaggaagggtcataacaaatgcgtgtttagtattagcaataacactaattattccctcacatggtgcaacaagtttattatcggtaatttcaattgcaagaccatcaccgaccattttgttagcaaatgctttgtcggggatattttccagacgaataactttgccacaggcaggagcacatactgtattttttttattttttaatagtctagtaaaaaaattcattcattatctccttttaaatatagaaaaaggcattagtgatatcaaaaaataatcactaatgcctaatttaatagtaacatcgttatatttataatatcgactaaataattatatgtcaagaatatctttaaatattcttatattataccaattattttataaaatgataatatgtagttatgatttaatgtatatagccacagatatatctattgacatgatttgataataaaaggtataatttcttacatagtgcgaacttagttcgttgtattttttttaacacaaagtaagcgctttagtgatacaataggtttggatatattattctgcacgaaaaatagtacattttcgttcggacaaaaaaaacacattaatttactaataatcaatgtgtttagaaacataaatatattgaatggaaaggtacagttaaatcctatattgattggggggatgggaatgatgaaatacatgcaaagattgggaaaatcattgatgttgcctgtatcagtgatgccaattgctgcattattaaagggaattggttattggatcgacccaacaggatggggaagtaataatgctattgctgcttttttgattgaatctgggggagcgattattgataatttaccaattttatttgctgtaggaattgctattggaatgtctcaggaacgagagttaacggtagctctaagtgcggttgtttcttatatgattgtttctaggctgctttcaccaccggctgtagcattgataaaaggaattcccgaagcagaagtttctgctgcttttgaaaattctgcaaatgcatttgttggaataatttcaggtcttgtagtggcatataattataaaaagttttcgaaagtaaagttacctgatgcgttatctttttttggtggaaagcgttttgtcccaataatatcgactgcttcaatgctagttatttctttattattactaattgtttggccgtttttttatgaatgttttgtatcatttggagaaatgatttcgaaattaggaccagttggagctggattatatggattttttaatcgattattaattcctactggattacatcatgcactcaattctgtcttttggtttgatgtggcaggaattaatgatattggcaaattttggggaacagtgtctggaggcattaaaggagtaactggtatgtatcaggctggtttttttccagtaatgatgtttggattaccagcagctgcaatcgctatttaccaaagtgctagacctgaacgaaaaaaacaagttggaacgattttattgtctgctgcttttgcttcatttgttactggggttacagaaccattggagttctcttttatgtttgttgcaccagtattatattttattcatgctctattaacaggaataatgctatttgtggctgcggtatttaaatggcttgcgggctttggcttttcggcaggattgattgattatattttgagtattaaagccccgttctctaacgatatatttatgctgattccacttggattgatttgtgcttttatatattattgcatttttagattcatgatagttcgttataatttaatgacacctggtcgggagactgatgaagatataattgaaattgaggaagaggaatacaatattacattagaaaatcaagactatgatgagattgcaattgttttgatagaagctttgggggggcgaaataatgtgcagtttgcagatagctgtattacacgattacgtgtggaattaggtaatcctgatttagttgatgaacaagctatattagctactggagcaacaggaattataaaaattggaaaaaataatttacaaattatcataggcaccgaagtacaatttattgtcgatgccatgaatgacatattaatgtaaatggatggaggcaataacattgaagatactcaaggtttttaataataatagtgttgcagcaatatcagatgagttaggtgatataattttaactggttcggggatcggttttcaaaagagaattggtgatgaagttgacgaaagcaggattgaaaagacatatttttttaaagatgatcagcagaaacgatttgagcaatcgattgaaacagtacctgctatatattttgaaataactaataaaattgttaatcaagctaataaggaattagatacagattttagtggtgaaatatttttagcaataagtgatcatatttcatttgcagtaaaaagaaaaaaggaagagatttatcttcctaatgttgttttgagtgaaacaaaagtattatataaaaaagaatataaagttggtttatgggcacttgattatatagaagaaaaaacggggatacggttagatgacgacgaagcaggttatattgctttacatttagtaaacttttcactcgataataaggcaaataatgcaacgaaaattgttactttgacaaaagaagtactaaatgtgattaaattatcaatgaaagttgacttagaggaggattctctaggttatgcgcgaatttcaactcatttaaagtatttagcggaaagaatttttagggatgaaattgatgaattgcaagatactacagcggatatccgggaaatgttgaaagaagatttacgattgtctttgtgtattaatcggattgttaaattaattcgtgatcgttatgattatgaattatcaccagacgagcaaacttatttatgtatacatataaaaaagaacgcaaaattataatggaagcgcttgacgtttactaaatattttgctaatatttacttgtaaatacggattgttactctaagcaggcaagaccaaatatgtattatgttttttagcataattatatttggtctttatttttgtttaaaatctgtattgatttatttatataatgtataactaatattgataatttttgggaatgggactcgatattaactatacgggaaaggaaaaggagataatgagaaaaattaaaaaaaatactcataaactgatgtctatgtttttggcagtactaatggttttcggttgttttagtgcatggccaacacaagttagtgctgctgagtcagattatgaaatttatcctaaaccacatttgatggaatatcaaagtggtgattacgttattcatcaaaatattaatattgtatatgaagatggtattgatgaatatactaaagctagaatgaatgaggtattggcaatcaagaagataaatgctactatctcaaatgaaattaaagaagatcaaactaatatcttagtaggtattaaaggatcagatggatacgttgataaacatgtatctaaaaattacacattaaaaacaagtggattatatgataaattagattcatatttattagcctcagataatgggacaattactgtattaggtaaagatactgatgctgcattttatggaatcactagtttatatcatatctttaaccagatggatagttattcaatccgtaactttgtaatggaagattacgctgatgtagctagtcgaggattcattgaaggatattatggaaacccttggtcaacagaagatcgctctgaattgatgaaatggggagggtattataaattaaattcatatttttatgctccaaaagatgaccctaaacataattctaaatggcgtgaattatacagtgatgaagaaattgaaacaaaaataaaaccgttagcacaagctggtaatgaatcaaaatgtcgttttgtttttgcattgcatccgtatatgaataatgcaattagatataacagtgaagaaaattatcaagctgatttaaaagtaatgcaggctaaatttgctcaagtaattgaagcaggtgttcgtcaaattgcaattcttgctgatgatgctggaaatgttggtggagataactacattaaaactttgaaagatatgactgcatggatcaaggaaatgcaaaaaacatatccagatttaaaattaacattaccattttgtactcaagaatatatgggtaatggccaaggttactatacgaatttcccagaaaacgttcaaattgttatgactggtggacgtgtttggggtgaagtttcaaataattttacaacaacttttactaataatgtaggtcgtggaccatatatgtggatcaattggccttgtactgataattctaaaaagcacttgattatgggtggatatagtacattcttacatccgggggttgatccaaataagatccaaggtattgttctaaatccaatgcaacaatctgaaccaagtaaagtggcaatttttggaaatgcatgttattcatggaatatttgggaaactagtgaagaagcagatgaaatttgggaagattcatttaaatatgttgatcataatagcgcagaagtaacagctgcttcggatgccttaaaagaactatcaaaacatatgataaatcaaaatatggatagtcgtgtaacgccattacaagagtcagtagaattaaaagatcgtttgaatcaatttaaaactgctttaaatagtggtaatacaatcagtgatgatttatttaccgatttaattaacgagttcacaaaattacaaacagctgcaaaaacttatcgtaatgaagcaggtgacactcgtataaaagatcaaataatttattggttagattgctgggatgatactactgaggcagcgattgctttaattaatggtgtcaaagcagtgcaagatggtgctgaaaatgaccaaatttgggacttgtatgctcaaggtcaagctgcttttgaaagatcaaaaacacataatttccattatgttgatcatgatgaatatgcggaagtaggggtacaacatattgtaccgtttataaaaacaatggaacaatacttatctgatgttgcatcatcaattattgatccatcaaaacaggtaacaaaatttattacaaatcgtgatgatacacctactggagctatttcaaatgtttttgataataaagccaatacggaaattgtttataaaaatccaaattctataaatgaaggtacatatgttggtgttagttacacaaaagctattgatgtagataaagtgatatttagattaggtacaaatagtaattctaaagatacttttgcaaaatctaaagtgcaatttactaatgatggcaaagaatggaaagatttggatggaactatttataatctaccaaatgaagttgttttagaagatttagaattacaaaatgtaaaaggaattagaatgattgccacagaagcgaaatctaatacttggttaggaattcgtgatattgttgtaaatccaacagatgaacctattgtagataatgatatgggaacattatctatagataaattgtcattacaaggcggtactcttgcaaaagtaacagatggagataactctacatttgctcactttgctgaagatccgtataaaggtggcacaattaaagattatatacctattgatgcctcattgattttaacattcaaaaatcctaaaaaattaggaacaattaattttgttcaagatagtaaaactgataaaattacaaaatatgcacttgaatatacaattgatggtaaaaattggcaagaaattgcaaaatatgatggtcaagcagcagttaatgaggatgtttcagcattaaacttaacggttaaagcagttagaattagaaatttagaattaaatttacaaaatgatagtgctggtttttggtggaaagtttatgattttagtgtaagcaatcctgcagctatagaaaagacatttatgtatactgatacatgggaagtctacaaaggaacagagtcaaatctaacggatggagataacactacagctttagattttaatactaagcctggtgatactagccgcgttggtgattttattggttgggattttggaaaaacaattcagataggaaaagttcatgctgttattggtggagatcgtaatgcgggtgacaagtggcttaaatatagtttacaatactctgctgatggtcaagattggacaacatataaatcatatgaaggtgttactaacggcaaagatgttattgatgagaatttacgtggagtagaggcaagatatgttcgtttagtaaataatgaacagaaaaattcttgggtaattttctcagaatttgatgttgctcaatttgatcctattaaagattatgatgatacaaatgtatacacaaatacagaatatagattgataacagaaagtaaagaagatttaactaaattgatgtatgatgaggtaatcacattaactcaaggtcaatatattggtgttgatttattaagaattaaagatattagtgaaattgttgttgatatgaataaagataatttgactatagaaacatctaaaaatgcacttgagtggactactgtaaaaactaaaactagtgaattacctgatgctcgttatgtaagaataattaataatactgattctgccattacttttaatcttaatagatttgaagtacattcaaatgaattatacgctccttcattatatgaaacaacaatgggaattaatagttcatggggagtagcagaagatagtcgtaataatggtgcggcttttgatggtaatattgatacaacaacagaatttgcagatctgccacaaaaaggacaatacattatttatgatttaggacaagaaagaaatatttctaaaattcaaatgttctgccaagattctgcagtaaattatattcgtgatgctgatattcttatttctaatgatttagaaaattggacaaaggttataacaattggtgatggagtagaaaataaaaatgatgcctctgttacttgtataaattctgatgcaggttataaagcatcaagtacttatcctaataaggtattggttgaagggactgctgataatgttaaggctcgttatttaaaaattttaatgacagcaacaaataataatcgtgcagttttattcaatgaaattgtaattaatgatggtgagtatgttccggtatcaaatgatcctacttttgaatcaaatgcagtggaagtacaaggatttgtaccacaaaatatgtttgacggtgatttaactacagcatataaaccaaatactactgatgcagggtatattacatatacactttctgataatttagatgttaagaaaataaatatcgttcaaaaagggacagtaagtaatgctaaggtaatggctttagtaatggttggtgaagaaaaacagtgggtacaagtaggcactttaagcaaatcactaaatgagatatatttaccatttgatatgacttatgaattgaagattgtatgggaagcaaataatatcccaacaatttctgaaattgtaagattaaatgatgatgaatttttaccagaattagaagcattacaaaaatatgttaactcattaaatgttgatgaaaataattatactgcgtcttcttatgctaagtatgttagcaaattgaatcaggcaaatgaagttttatcaactgcttcaggagataagaaattaataatcaaagcatatagtgaattacaaattgcttatactaatttagttactcgtggtaatgcccaattaattaaagatgaattaaataaaattggtgcattagttgctgatgattatactgattcaacatgggaggcattacaagataaagttaatgaggctaatactttattagctaaaggtgaagaagaattgaacgttaaagaagttgctgatatggtcaacatattacaagtagctaaatcaaacttaattacaaaagtttcagtgagtaaagaagtattacaaaattatatagatacaaatgagttggataatttagatactagtaaatatctaacatctactgcaacaccatttgtagatgcattaaaggtggcacatgacctaattgctagtgatgatgcgacagttaaacaattggaagatgctttaacagcattacaagaaacacgtgcggcattggttttaaaagcaactgctgatgaaattaatgctataaatggattaattgatagttataaagaaaataattatactgcttctacatggaaagaatttgttaaagtactaacagaagttaaagatgctttaaatgatgaaaacagcagtgaagatatagctgaattaacaaaaactttgaaagctgctgctgaaaaacttgtagaacgaggagatttaacagatcttaatattttattagaaactgctgaagcacttgatgctaatagatatactgaagaatcttataataaattattggatattattaaaactatcaaagtagagttaaaagatagttcagaaatgctacaaactgatgtagataaactacaggctaagttgcaagcagcaattgatgcattagaaataaaaccatcagttacccctaatgaagatggtataattaatggaaacactgcatcagatacaacaactagttcaaaaactggtgacgatgtagttattggatcattcttagtattaggaatgttaagtattgctggattatggctataccgtaaaaaagaaaattgttaatagcgatatatttctctctctcttttagaagaaggctgaataaaaattcagctttttttctatttaggtgagtatatatattgacaaaaaattaaaatatgatatattaatatcagtaatcattactgttaattataggtgatgatgaaataaataatataaaaaggagataattataatggctaaatttgtatgttctgtatgtggatatgtttatgaaggagatgcagctccagaacaatgtccagtatgtaaggaggttttttacccagacgctaaagctttattgttaccacgcgcatagcacgtggtttttgtttcacaataaaaaacactatgtcatgcatagtgtttaaaacatcgtcgccattaacaatactgcgattagattttttgcagcatgtaaaatgatcggagctataattgtttgacgtttttcatatacgattgaaaaagataaacctgccatcatatatggaatcaatttaatccattcactcatatcaccagctaaaatatagctgtaaacatgtaacaagccaaataggaatgctgaaatcaaatgagcccaaaccatatttttttgtcgtaaactgttgaaaatcagacctctaaataacaactcttcaataaatggtgcaataattactgattgaaaaaacattaatagaaaattagattgcacaagagtttccactaatgtctggttagctgcttcgcctgattgaggggctacaagattgacaatcagttcccctgcaattgaaaataaatatgctaaaccaatcccgatcgtaagcacccatattatattttccaaaaagtcttttttaaaaacaagccagttttctttaataaaacccttaaacacaataatcaaaggaatagcagttgcaattccgatgaataaattaaaaaatgcatttaaactattagttgaaaaatcattagctatatatactgtatatagcttcaaaaaataattaattacaattggtgcaaaataaagataccagggaaaaatcaatatgacccctatcgccttttgcctactatttaatttaattttttttatcaaattcaaattaacacctcgttaaatattatttttatcttctaaatcaatttcttcaaaaaataccgctaaactagtatttagttcagcaccaaacaaataagtagtcaaagccgccacgataatattcaaaattaatggaatcggtaaaatcatctcaacaacagcagaaagtactaatactaagatagcccatcctaaatatgacaaatacagcataaataaagttcgtttatgtcctttcattaaacgagctgattcactcattgccttggcaccgcgtatattatatttttctaatacaaaaggtgttaaagcaaataccaaactataaataaacgctacaattgcaataatgatgataccaataaaaaagattactcctagtgttcctaatgcttcaattacagttggatcatttaaatatgcacttacattagtagagtatacagcagcttgctcaataattgctcctaattgagaaaaaacattactgtctactgtaaatctagcaattacgaatatgattaatccaagcagcatcataatcaccaataataatatttctctaataaaatatgtgccaaataaatctttaaaacgtcttaatccgactaccccatcttgttcaatagtgacctcatcaccttgttcattgactgtttttaatgcagttaccacattcccatgaccaaagggcaacattataatagttacaatcaatgaaagaaatggtatcaccccgccaatttctgaaccaatataattagccaaagttgttattacactaataaacacaaatactgtaactatattattacgattaactaaaacacttttagcctttaatttaatatcacgaacattcatctttcctctacctccatggggctattatagcaaatatctgactcaaaaggaaactatttaatatccaagcttgtcttaattgcttgattgatcagattcattacttggctatcaatcattccaactttttctttaattcgctgtttatcaatcgttctaatttgttctagtaaaactacactctttttttccaatgaactgcaatcaaccatcacatgggttggtaacggattttttgttaatcgtgaagaaattggcgcaataatcactgttgtcgaatatcgattgcccttattattttgtaaaacaatcacaggtcgatatcctccttgttcactccccactaccggagataaatcagcataataaatttcccctctatgtatcatatctacaactcctttagtgcagtatatgaattagaactttttttattctatgaaaatctttttactaatcggataattatgatatgatatttgcgtggaggtaaaaagatgataacagcagtaatttttgatatggatggtttaatgattgatagtgagagagttacattcgagggatataagcatgtattagctaaacataatttaacattatcattagaagcctataaaactcttttaggaaagcctgttaaagcagtctatgagcttttccataaagattatggcgacgattttgatgttgaggaaacaattaaagcagttcatcaatatatggctgacttatttgaaaatgaaggggttcctttaaaagaaggattaattgagttactaaagtatttaaaagaaaacgactataaaacaattgttgcaaccagttcacagcgtcatcgtgttgatcatattttagaattatctggtttacaaaaatattttgatgattccatttgtggtgacgaagtaacaaaaggaaaacctgatcctgaagtatttttaaaatcatgccaaaaattaggaattacgcccgatgaagctctggttctcgaagattctgaatccggaattaacgctgcctatagtgcaggcattaaagtaatttgtattcctgatttaaaataccctgatcataagtttgcgataatgactaataagatcatggacaatttatcaaatgtccgtgattatttggcgaatgaaaatcattaaataaacaccaagaattaattcttggtgtttattaatttatcgataaacataacaattctttgtgtattatgaccatcttgatatttaaaaaacatatctctaaatgccttaatatcatattttttattaccttgcaaggctgcaataacttgcgtttcattataacagattgctccgggcatgacccttcgataatccacaaaacatcctaatgtttcaatatattcatctaaatccggaacaaaaaaacacattggtttatttaataaggaataatcaaagataattgatgagaaatcagaaatcaagacatcacaaactgcgaataaatcatgagtattttcatgattcatattaatcactctagaatcgtctgatagcgtagttttcaataacaatgggtgaaatttaaagattattacgtattcttctcccagtgcatttaaaactgcttgagcatcaaagtcaactgttttaaaaccctgataaatatttcctctaaaagtcggtgcatataaaataaccttttttccttttagaatcggatatctactatacatacgtgctttcgcttgtgttaaataatatggatcaacaagatgatccacacgtggcattcctgtaataataacgccctgctcggaaacgttgaaagcttcttgataaggctgcttccaataatcactatttgcaatcacatagtcataatttttaataggatattcacgtttgatagcatttccaaactttttgattgctccagtcgcatgccatacctgaataactttaacgccaggtcgtttaaaattactaattacatagttattgtctgtaatcaaaacaactttagaagtattaattacataaatttgcttaatacagtttaacatatacaaaaaattgttaattaaactttttttattataatttattaataccatttttaaactatatttgttttctttttttaactcctgataaataagttcaagatcactttcaagttgattcgactctaatgaaataaaggctatttgtccttgcttgattgaacatcttaaaacaaatatattggctatttttaagataatattaataataattttctttattcccatctcatcacctactttaataaaatttcaataacccgtttactcgcattgccatcttcatgattattaaactgttcattaaatatttgcaatcgattatagtcaaatttttcagagaaaattttttggatcaattcatcctcactttcaataacatcgcctggtaaatcatgataaatatctaaataaaagcctcttaactcatcacgataagtgtctaaatcatacataaaaaaataaattggtcgttttaatattgcataatcaaaaaatacacttgaataatctgtaactaagacatcggcaattaaatacaagctgctaatatcttctttaggatcaatgtagtagacaaattctttaactgcctctaaatcaaaatcatttacaattaaataatggggtttaaaaataacaatataatctgtacctagaattttttgccactttttaaagtcaacttctaatttaaatgtatacccttttaaattatatgaattgtcacgccaagttggcgcatataaaattatcttcttaccttcaggtaaatttaatttatcttttattttttttatatcatcagaattataatttgataaaatatcatttcgtggatatcccgtttcaatcaagcgctctctctcaatcgcaaaagcactttgaaagacttcagttgtaaaagcactaggactaatcatataattatacttacttacatcattatcgtaggttgaacgcatttcttcaacgctcatttcactacgataaaaggttgttccttctggaacttcaatatcatgtgctaatttttttaatggtgtcccatgccatgtttgtaaataaacttggctatcttttttcaaaacatattttgggagcttacaattagcaatccaatatttactacgcgctagatagaaaaaataagcaatactaaaatactcaataattctagcattttcaatttttaattttttttgtttatgattttttattgcataaatgcaacgataatcagcatattgtgaatgttttgaaagatattggtgaattgccattggattatcagaataaccgcgaccatgaaaagaaataaaaagaattgttttttcctgacaaggaataaatcgatatacgaatcgatataaaattctgattaacttaccgagtagtttctttaatattttcatttactttcctcccataaaaataaggggtaaaccccttatttaaaaactgcttcaacaactcgcatagcagcattcccatcttcccatgaacaaaaacgttcataaaattgttcataacgttgttgatattcttgattcaaactattcagattcttgattttatcaataacttcttcagtagtataaaccaatggtcctggtaattctgtttccatatcaatataaaaacctcttaatacatcacgatatttatctaaatcatacgtatagaataacatcggcctttttaaattagcatagtcaaaaaacacactagaataatccgtaatacaaatatcactaattaaataaatttctgtaatatcatcatacttactcaaattatacgcaaactcttctagtcccgtaacatctaatgcatcagcaatataatgatgtgttcttaacaatacaacatattcatcaccaagctgctgctttaataaatctaaatctaatttcaatttaaacttatatttaccatttccataatactcatcatcacgccatgtcggagcatacaaaatagtctttttatctagaggaatccctaattttttcttcaattctaaagctattgcatcacggtttggtaacgataataaatcatttcttggatatcctgtttccagcatgttaccatcgtacataaaacaacttttgaaaatatcactagagaatttattcggtgcaatcaaataatcccattcttgtttttgacgataaaattgagctttataggtcggcgaagcagcagtaacctcttcttgatcaaacgctaaacgtttcagtggcgttccgtgccacgtttctaaaaaaacttgttcctcccgctttctaaaccataatggctgacgaatattaaaaacaaaatatttagaaacgcctaaataataagcatattcccttgtgaatcttttgacaatcttaccttcgtaaggcaatttttctttaggatcatttaatacccaaataaacttatatttacctggataattcttcgctaaatattcataaatatatttaggtgaatctgcataactttttcccataaaagtttcaaacataaccgtattttcttcaagcggtttattaatatatttatgacgatataaatatttattcatctcgtttttattttttaagatctttttaaactttatttttgctaaatgccggcttacagtcttctttgctaactcaagatcaccatttagaccagctttgatcatttttttactataacgagaacttttattcaataaacgaggatgaatattttttaatatttctcccattgctttaaatcgttcgttacgccaaatatcatctttactgcgacgaatctttcgtgcaaaaaactttgtgtaatatctaagcattttcgaatctaaataataacgaatataactatctggagctactaaagaagcactatagcgataagccatcaaaaattcatcaaatttattttcagaatcttttatttgtgataaagcaggtgtattgattggatcattatgttttcttttaacaaaaattgcttgttcaacacgatcaaaactctttgcgtaattaactaattggattacaaaaggaacatcagtgtaatagaaaaaatcttcgttaaaacgaatttgatgctcatcaatcagtttcttttttattaaaacatttaagacagaaatattacgaatagcatgtcggctccgaattaaaacatctaccatatattcatcaacattattttggtcatatactttttcaataaatttatcatcataatcatgatctttatcttttaagtttaattcattatttttttcatcacccatggtctcaaaaactttctttttgaaccatgtaaagcgtctaattcctgcaactaaatctaaatcattttgattagcacaagtaattaataattttaaagtatttggcatcaaataatcatcacaatcaataaaatagatatattcaccacttgcctgttctaagccaatatttctttttttagcaacactagaattttctccagcttcaaggatttttaaattaatatcatacgctttgatatcttgatcaatctcttttttattatttacaacaagtaaagtttcataatcatttaaccgctgttcataaacactttctagacaatcatgtaaatactgtttgtaacgatcgtaagggataattatactaagtttcatctttacacctatttatgtagatcgtccttaatttttgttgttgaaataccatcagttcttggtaaatagacaacttcacagtaatcctttaaaaaatcaaatttaccttcccaatcatcacccattacaaatacatctacatcatgttcttgaacatctttaattttttgatcccaagattcctcaaaaataacttcatcaacgtatctaatcgcctctaaaatcaattttcgatcatgatcactatgatatgcctttttccccttctgcgcattaaatgcatcactacttaccgcaacaatcaagtaatcacccagcgcttttgctcttttaataatattcaaatgacctacatgaaataaatcaaatgttccgtatgtaataaccttcttcattattttcacctatccttttatccgatctaaaactttttcccaaaatccaatttgaggattttgaacaattcgttttttaaatttattatctcttattttagccttttctttgttcgttaaactgttatagtaatcaacgtattcaccataatgatcacatacttccccgacttcaccatattcttttaacattcctccctcaatccacattgctgtttgacaaaaatttcgaacttgaggcaatgaatgtgaaataaatataatcgttttaccttcatcttttaattcattcattttatttatgcacttttgtgcaaaacctttatcacctaccgataaagcttcatcaacgataataatatctggatttaaatataaagagattgaaaaaccaagtcgtgatttcatcccgctagaatatttttttacaggttgatataaaaagtctcctagctccgcaaattcaataacaccatcaataatctcctgaatctgcttttttgatagtcctaataaagcacctttaacattaatgttttctaaacctgttagctgtttatttaaaccggtattaatagcaaccaatgattgttcaccattaatatgcatgacaccctcatcgatttcgctaattcccgccaagataagtgacagagttgattttcctgagccattagttcctaaaatccctactacttccccttgtgggatttcaaaactaatattttttaaagcataaaatctttttgtttcactacttttagtattaccatcatttttctttttcaatttatatatttttgaaacattttcaaatttaattgcgtaattttccatttctaccacctagatcatatcaataaatttatgtttgaatttatacatcatataacagccaacaacaaacagtattccagtaatcccccagaaagccagcatttgtttccaataatgcataaatccaaggtgatataaaaaacaatctcgatacccacatacaatataatagattggattgattttcatgacaaaacgaataatatcaaacaataacgtctgttcactaaaacgagaaatcggccataaaataggtgttaaatataaaatcaaacgcatacacgctaaaatcaacttacgagtatctcgagcaatcatattaagcacagatgtaatcatcgctaaactcacagcaaaacagcaggccgcaaagcaataatatataattcccaaccactcgattgatggatagacaccttgagtacaataaaaaataatcattaaaagcaatatacaggcatgattaaataattcctttaaaactaccgtagctggtaaaacactaactggaaatttcattttagtaattacacccgtctttgaaaaaatggcattagccccttgagtaatacaaggattaataaaaaaccaaacaaccattcccgccaacatccattgaataaaaggaattccatctacatctttacgattcattactaaaccaaaaacaaaataatatgttaaaatttgaatcaatggattagcaaaattccaaaaaatccccaaacgggaatcacgaatatcagataataattcatatttcgaaattgaatatattctaaataaatttgagaaattctcttttagaacatatttaatactttttagcattttctacctccaaagctacttttatttacaacaatagcattataattatagcacaatgataatgcaattaaaatatctttattttagggggaaaatataaaaaaagaaggtgtttttaccttctatttactcatccagctttcgtcacttggatcttttttccaagcctttaatttttccatatcagcttctttaatatagtcattttcttttgctacaccgatcaatgtatcataatcagtcaatgttacatatttacattcagccgcttcaaaattaattgttgcttttggtaatccatatgtgaaaatagcaatcattccaattacttcgcaaccggcttcttttagcgcttcaacgcattctaatgaactcccccccgttgaaatcaggtcttctaccacaacaactttcatgccgggttctacttttccttcgatccgattgttacgaccatggctttttgccccaccacggacatatcccattggtaattccaaaatatctgccactaatgcagcatgagcaattcccgcagtagctgttcccattaagcattctgcttctggaaaattttcttgaactaatttagctagtccagtttctacatctttacgaacttttggatatgataatgttaaacgattatcacaataaatcggtgatttaattccactagcccatgtaaatggttcatttggtcttaaaaaaaccgcttgaatatctaataaatctttagcaattaattctttcattattcttctcctctacccttgaaaatcttgatatacttttttatatgttgcgtatggatcagcagatccagtaatcgttctacctactacgatataactagatgttaattcgcgtgccatcgctggagtagtaacccgtttttgatcatttacgctatcatcagctaaacgaattcctggcgttactgttatgaattccattcctaaattatcatgaatcactttagattctaatggtgaacaaacaacaccatcaagtcctgcttctttagcattagtagcccactttaaaacgacattttctaatgtatcgttaattaaaagctcgttatctagcacttcttgatcaagtgacgttaaacatgtaacggcgatacataaaggtcgtttatcacctgtcttgcctgcttctaatccttcaattgcagctttcatcattgcgatacttcctgaagcatgaacattgaccatatctacttctaattttgctagttgcttcattgcactttttacagtattaggaatatcatgtaattttaaatctaaaaaaatgttatgtcccatttctttaatcattttgatgatttcaataccttcaccataaaatagttccattccaacttttacatatagtttttcatcattgaatttttccaaaaattcttttacttctgccttattttgaaaatccaaggcaatacaaattctactatctgtcatacatacctccacattaatttgattatatcaaattatcaaaattaatacattattaaattaattttttatgcaaatacttttttcaattttatatgattttttcttagggttatccggaatatcattttaattattttaatttaaaccaataaaaaataattttcttaccattttataaataattataattgctatcaacctgtgcgctcgttctttaaacaggatggcaaaactgtcgttttaaaccagcaattaataatctaacgaagaatcaaattcaaaaaaaagtatatcctaacttctgcatagttaagatataccagtttaatcccgtagggattatcccatacggttatagtattcaacgattaatgactcattgatttcttgatttaattcagatctttctggtaaacgagcaagttttccagttaatttagtatcatcaacttctacaaaagcaggagtatgtactctagcttctaagctagctttaatgattgctaaatttttagatttttctttaacttcaataacatctccaactttaacgcggaatgatggaatatcagtcttaattccatttactaagaaatgaccgtggtttactaattgtcttgcagctcttcttgtaggtgcaaatcctaatctgtaaacaacattatctaatcttctttctaataagcagaagaaattataaccatggataccttccattttacctgcttgtttgaatgtgttatggaattgtttttcatttactccatacatatgtcttactttttgcttttcagctaattgtaaaccatattctgtttgtttttttcttttttgaccatgttgacctggagcataagctctcttatttaattctttaccattttctaaagtagagaatcctaaacgacgagataatttccattgaggtcctgtgtaacgtgacatttgtcttcctccatttattgttttatttgcataaaacaataacattgcatagattatttgaattgtgtttatattaagtatttcactttgcagctagctactctacaaacttaagttataaacgctcttttcaaaactctatgtgctgctatcatttgttgcttatttactatacctttttttattgactacgtcaacatttttttctaaaagaattttttctttttcaaaattaacatttcaataattacaactaaaatacttgctccaataacaataatataaccataaggattatttaactctggcatatttttaaaattcattccataccatcctgtgataatcgataacgggaagaaaatagttgttgcaactgttaaaacagtcataattttattttggtgggtatcaattttattttgatacatttcctttatttgcaaagaataatcttttaaagcatttaactggttatccaaacgatcaatcctacgtgcctgcatgctgaataaatgacattcataatcatttaagaaatctgattcattatcacttaaaatatcgatcatatcccccaactgattataataggaatttaaaattaatagttctttacgcagcaagattatctcattatttatttgactattgaaattaaaagctattttgtcttcgatgacctgtaaacgatcagcatattcttgtaaatacattccatcatcaacagttattaagaaaatcaaatcatgaaaaaatttgttcaaacttagacgattattagtatatgtatctttcattttttcaataagtttcatcacataatcgttatcatcaataaaaatcattttttgttctgttaaataaaaactaaaacaatgttttatttttaaatcctttttgtcaggtataacaaacgctccgcaaatcacatcgtaaaataattctactttacagtacataatatccccaatatgcctaatcacatggtttgcatgattttccttttgatactggtttatgaaatcttctttactaagaatatcaataactaagcttccttctttataactatttgtaatttctttttctaaataataccgcattatctcacctacccggataaattatagcacattaagtcaacttagttgaacgttaaccataaatatgataacctattaaacgaaagcgaggcaatacatatgcaagaaactgtattattatacaatattgataaaactgatgctggtaaagcaattatttcaattcttgaaaaactgaatgttgaagtaatcattgttaaatcaagtgatttaatgagcccgattgggtatattttaggtgctgataattttgaacgtggaactgaagcattaacagagattccacaagatgacatgatggttatggctggttttgaagataaacaagttgatttgctattacaaatttttaaagaagcaaacattcctttcattccgttaaaggcaattgtaactcaaacaaatgtaaattggacatttatgcaattattgaaaaatgttaaaactgaatatatggaattaactggaatgaataaagatatgatcaactagattatttgtcttgttagcagtatctatatcagcgttataatattttaattattattaaagagattatttgattcttagaagattaagtttaatcttcttttattttgttaaaaataaaagtggaggtaacttatatatggaaacaaaaaccaaaacaaatttattaagagcttttgctggtgaatgtcaagctcgaatgcgttatgaaatggctgctaaagtcgcaggtaagaatggaatggctattttacaagatatgctttattttactgcaaatcaagagaaagagcatgcgatagttttttacaattatcttaaagatgtttttaaagatgctaatgtttcaatggaggctaattatcctgttgatctagatcaggatttaagttcgttattagaacaagcagcacaacacgaatacgatgaagcaacatctatctacaagcaatttggtgatgaagctaaagaagaaggttatgttgaaattgcaacaactttttacatgatttgtgagattgaacactatcaccatgaacgttttaaaaaatatcataatttattaaccagtggtaaattatttaatgaccagtctactgtaaaatggatgtgtatgaactgtggttttatttatgaaggtactgatgcactaacgatctgcccagtttgtaaacacccacaaggttatagtctacgtcttgatgaatctcaatttcatttataaactagtaaaagcaatcctcttgaaaggattgctttttaagttaattttttaacttgtctaaactatttaatattaattataaaaagtctataattaaaatatagtccaaaaaaggagtttaattcaaatgagaatactaagttttaaaggcggaatccatccccatgataataaaagtctttccgccaatcatccaatcaaactattaaatcctggagatgaactgatttatccattatcacagcatattggtgctccagctaaagctatcgttgctaaaggtgatcatgttttagttggccaaattattgctaatggaaacggtatgatttctgccaatgttgctagttctgtctctggaaccgttaaaacaattgatttacgacttgcccctactggtttttttgttgattgtatcgttattactaacgatcaccaatatcaaagtattccagaatacaacacaacaaatgattatcataattatagcagtatgcaaattcgtgaacttatcgctcacgcaggaattgttggtttaggtggcgccggcttccccagcgcaataaaaaatacccctaaagatgatgactcaattaaatatgtaattatcaacggtgcagaatgtgagccctatttaacttctgactatcgtttaatgctagaagaaacagataaattaatcgctggcatcaaaattcaattacagttatttaaaaatgccaaagcaattattgctattgaagataataagccagaagcattagctcatttaaaaaaagtcgttgtagatgaagataaaattgaaatagcagccttaccaacaaaataccctcaaggaagtgaacgcgtattgattaaagtattaactaatcaaacaattgtagatgggatgttgccagcggatgttggctgtattgtcagcaatgttgcatctattattgctatctatgaggccgttgccttaaatattccactaattgaaaagattgtaacggtaactggtgatgcaatctttcaaccacaaaattttaaggttcgcctaggaactaaatatcagacccttgttgacgcttgtggaggttttaaagtacatcctcaaaaaatcatttctggtggtcccatgatgggtactgctttatttaatttagatgtaccagtttctaaaacttcttctgctttagtttgcctaagtgaagatgaagtatctaaaaccgctccaactgcgtgcattcactgcggccgatgcgtcgatgtttgccctatcggtcttattccacaattactataccgttatgccagaacaggcgataaagaaaactttttaaaggttcacggcaacgattgtatggagtgcggctgctgtaccttcacatgtcctgcaaagcgaaacatgacacaatcatttaaaaaaataaaaaaagcaattaatgacgatcgcaagaaaggagcaaaataatggataatttatttaatgtgtctactgctccccatattcgtagttcaattacaactaaaaatattatgtatgacgtaatcatttctttattaccagcaactttttttggaatttatcaatttggatttaatgcgtttcttgttattacaactgctattattacagctgttctaagtgaatatttgtatcaacgattgatgaagctgccaatcacgattaaagacggctccgcagccatcacaggcttattattagcgttatgcctatcaagctcattgccattgtggatggttgctttgggaagtatattcgcagttataattgttaagcaactttttggtggacttggtcagaactttatgaatcctgctttagcagctcgatgttttttattaatttcatttgccggaaaaatgaacagctttgttagcatcgacgcaagtactagtgctactccgctggcaatgatacaaaatggacaaaatgtcaatcttctcaaaatgtttataggaaatactagtggtacgattggtgaaacatcagtaattgctctgcttttaggcgctgtctacctaatttatcgaaaagtaattagtcctaaaataccgttgtgtatcctattttcattttctttaatcattttgatcaataataactttaacagtctatttttattacaacaaatttgtggtggcggtttaatgattggggcatttttcatggctactgactatgtgacaagtccgattactccaaccggtaaaattatttatggactggttattggaatattagctgctgtttttaggctctatggtaatactcctgagggaatgtcatttgctattatcattactaatttacttgtccctttgattgaaaaagtaacagtgcctaaaataaaaggtagtggaggtaaagcataatgaaaaaaaatcttctaaaagatattctcgtttttgttgtaattacagttgctgctagtttatctctagctatggttaattctattaccaaagacccaattgctagacaaaatgaaaaaatcatacaagattcttatcgaagtgtttttaaagaaggtcaaaattttgataataataaacaaataaatcaacttgttaaaaattttcctaatgttataaaagacaaaaaatataactttggtgaaaatggcattgtgatagacgacgttttagtcgttacaaatgataaaaaagaattaataggacatgttgtcaaagtcactactgaagatggttatggcggtgatatcacattagttgttggaattgatactaatgatgaaattactggaattgaagtcctctcaattgatgagacggttggattaggaatgaatgctaaaaatgataattttaaaaatcaatattatcataaatcagtaactgattttaaaatcaccaaaactggtaagcaaaatgaagatgaaattgatgctctaagcggagctacaattacttcatcagcttttaacaatgccattaacggagccttagcaatcaaccaggaaatcaaggaggctaatcatgaataaatatgttgaacgtctttataatggaatcataaaagaaaatccaactttgattttaatgttaggaatgtgtcctactcttgcagtaacaacttcttctgtcaatggattaggaatgggcttaacaacgatgattgtccttgccgcatcaaattttatgatttcgttcttacgaaaaataatccctgaaagaatgcgaattccttcttatatcgtaattgtcgcttcaatggtaacaattgtccaattactattacaagcatatttgccttcattatatgatacattagggctctatattcctctaattgtggttaattgtatcattttaggacgagctgaagcttacgcttcaaaacatagttgcgttttatcgttatttgatggtgttggtatggggctaggttttacgcttgcactgacttgtattggtttaattagagaaatgttgggcagtggtactttttttggaattgagtttgcgccactttttaaagatttagttggcactaatatttatagcttttttgctcatcttgaacctgtaactatctttgtaatggcacctggcgctttctttgttttagctggtctaacggctattcaaaaccgtttaaaactgccaagtgcaactaataaaaacaaagatggtaattgtaatcatgattgtcttcattgtcgtagcagtgatgaaaaggcactttgtgatttaaaggaggaaaaataaatgacgggaatgattttattattaattagtgtcgctttagtaaataatgttgtcttaagtcaattcttaggtctatgtccttttttaggagtatcaaaaaaaattgaaacagcagcaggaatgggtggtgctgtcatctttgtaatgtctattgcttcaattgcaacaagtttagtttacaaaatactagtactcttccatttagaatatttaaacactgttaccttcatcttagttattgctgctttggtgcagctagttgaaatgttcttaaaaaaatatagctctggcttatatagttctttgggagtatatcttcctcttatcacaactaactgtgccgttttaggagttgctatcacaaatgttcaaaataattatgatattttgacaagtcttgtttgtagttttggaacagctgttggatttacgattgccatcgttattatggctgggatacgtgaaaaaatcgctgataatgatattcctgtttcattccaaggttcccccattgtactaatcacagcaggactgatggcaattgcattcattggcttttcaggtctaatataaggaggaaaatataagatgaatgaaattataattgcggccattattgtaggtgcaatcggtttacttattggtattcttctgacaattgctagtgaaaaatttgccattactgttaatgaaaaagaaattcaaattcgtgaagaacttcctggaaataattgtggggggtgtggctatcccggatgtgacgggctagccaaagcaattgttgctggtgaagcaaagatcaatcaatgtcctgttggaggaaaaagtgtagctgacgccattgcaatgatcatgggagtagaaagtgaagaaacaatgcgaatgacagcatttgttcgttgcggtggtacttgcgaaaatgcaacgattcagtacttatatcacggtatcaaagactgtaataacgcagccatcgtccctggtggtggagataaacaatgtagtcacggctgcatgggatacggcagttgtgtcagagaatgtgaatataatgccatttcaattattgatggggttgccgttatcaatccagacttgtgccaagcatgtggtaaatgtcttagagtctgtccaaataatgtaattactttgattccatatcaaaaacaggcagtagtaaaatgtaattcaaatgaaccagctctccgagctcgtaaaaattgcgctgttagttgtattggctgtggtatatgtgctcgtaattgtcctaataatgcaattattattgaaaactctttagcacggattgattatactaaatgtacaaattgtggactttgcaaagaaaaatgtcctcgaaaatgcattataactgcttaaaattatattaatcaaatgaaaaaggtgactttgtgtagtgaacttcattgtatcaaaaaatcaccttttttacttatcacttttcacttatcataaaattactaattaatctactctatacttcattcttttattatacttattttcctctattaataaatatgttcagtacagtaattctaattatcatctcataaactactttaatttttctcttgacttgaagtaaacttcaagatgtatgatattatcatctataaaaagtattttttatagtatctagttatatgggaggtaaatatgtttttagaaaaaatagacgatacaaacgatcttaaaaaattgaatagaaaagaattaaaagaacttgctaacgaagttagagcagcattgattaataagattagtaaagccggcggacatagtggtcccaatttagggatggtagaaatgacagtagctttacattatgtttttgattcaccaaatgataaattcgtttttgatgtttcccatcagtcttatccacacaaaatattgactggcagaaaagaggcatttctagatgaagaacatttccatgacgtaacaggatataccaacccacttgaaagtgaacatgacatgtttacaattggtcacacttctacatctgtatcacttgctcttgggttagcaattggaagagatttgaataaaaaagccgaaaatattatcgctattattggcgatggttctttatcaggtggagaagcactagaagctatcgattatgcaggcgaatataataaaaacttgatcattatcgttaatgacaatgatcaaagtattgccgaaaatcatggcggtatttatcaaacgcttaaagaattacgagacactaacggaacaagtaataacaatatatttacatcatttggtcttgattataaatacttagatgatgggcatgatatcgaaaaattaattgaattatttgaaagtgttaaaaatatcgatcaccctatcgtattgcatatccatacaatcaagggaaaaggattaccatatgcagaggtaaacaaggaagcttggcatgctggtggtccatttaatgttgctgatggaacatataaatttgttgatgaagatgatcaaaccctattcaatagcttgactaacttattaaatgcaaataaaaaggctattgttgtaaatgccggtacaccgatggggctaggattcatcgaacctgtaagaaaagaatatgtcgaacgtggacaatttattgatgttggcattgctgaagaaaatgctatggcaatgattagcgggattgctaaaaatggcggaatacctgtctttggaacttttgctccttttttacaacgtacatatgatcagctatctcacgatttatgtctgaacaataatccagcaacaattcttgttctatccgctggagtctatgggatgaattcaaatactcatatagctttatgtgatattgcaatgtttgcacatattccaaatttaatctatttagcgccgacaactaaagaagagtatttacaaatgtttaaatatgcaactacccaaaaagatcatccaattgcaatcagagtcccagtacaaatgattgaaagtggtcaagaagacacaactgattactctatccataataaatctcaaattgttcaacaaggtaatgatattgctattatcggagtaagtaatctgcttccattagccttaaaaacagctcaaaaatacaaagaggataccggtaaaaatatcactgtaataaatccaaaatttctaacaggtttagatgaagaattactaaatgacttgactaataatcatcgtcttattattactttagaagatggtgaattagaaggtggatatgggcacagaataagcagtttctacggtatgacagagatgaaagtcaagaattatggtatctccaaggcctttcatactgattttaatgctgatgaattattagctcaacatggtatatccgttgatcaattagtgacttatatgaaaaatagctaaaaactatatattattgttttatatataattctcattagtatacaataaaattaataatgtatttaaaaaaggctgtaacgtctaaagtgaactgcaacctgtcaagtagacaattgaaaaaatataaaatttttcctgccggtagattatctactggcagtttttatgcgatttgcaaataaattttatgtttttctattctgatataataatggaattctgttacatctgtgagccgtttctcatttagtgcatcggtagtaaactctcgattaagtaaatttttagctatatattgaggatttacagcctgtcctgtacatccattagtagagtatttaatagttgatttgatattaagtagtacgtagtactcgtttatcattaacatcaatgtcatgataagattctagatcatctctaattcttcattatcctctatctggtgactctgtatggagcttttcaatctcatcagtaatccgtctgtttttttgttcattttcagagctttctctgtacaatctccaaatgcagtttttcttccttttgtcataatagtgtgttctcctatttcagatgattttaactcttcatgattattatacttctttatccagagttgtaacttcaatcttggacaaattccgtattttttacaaatatcatccaaggaaccacgaccatctaaataatctaaaacagcttgctgacaccaaacatagatacaattcgattttggctttcttttccatctagatacaaatttacagcatataccttatcctcaatggatatttttcttttagacataaaatatgcttcctcctaagtgacaagtttttattatttcacttgtctccccagaaagaagcatatcaattttaatgcgttacagtctcttttatttataactatttaacaacaatattgacaattttattttttacaacaatcacttttacaatatttttaccctcagtatgagctttaacattttcttgttcaaacgcaatttccttcacagcttcatcatcagtatctttagtcacttgaatcttggctctaagtttcccgttaacttgaacacccatttcaactgtctcgctcactaacatattttcatcatatgttggccaagtttcatatgcaatcgaactatcatgtcccaacatttgccacatttcttcacaaatatgaggagcaatgcaagaaagcattttgataaaattaaatgcatactctttatatactgtctctgctttatagcattcattaatgaagatcatcatttgtgaaatagcagtattaaatcctaatgtttcaaaatcatctgtaacctttttaactgtttgatgatatacacggtcaagactatgatcattttcatcacttaatttatcttgttcgataaataaacgatatacccgatctaaccatttacgtgaaccatctaatccatttgttgaccaaggaagagcagcttccaatggtcccataaacatctcatataatcttaatgaatctgcaccatgagaagcaacaatatcatcaggattaacaacattaccacgtgatttagacattttttcattattatctccaagaatcattccttgatggaataatctttgccatggctctttacatttcactactccagcatcatacaatactttatgccaaaaacgagaatatagtaagtgtaatacagcatgctcagcaccacctacatacaaatcaacaggcaaccacttttctaacaatttaggatcacaaataacttcactattatgtggatcaatatagcgaatatagtaccagcaagatcctgcccattgaggcattgtattagtttcacgacgacctttttgaccatcaatctctacttccaaccaatcttcacagttagctaatggtgattcaccactatcatggggttgaaaattcttagtagctggcaattctaatggtaattcttcaaccggaacggttctcattgttccatcttccatatgtacgattggaattggctcaccccaataacgttgacgagaaaataaccagtctcttaacttataagaaattttcttttctccacacttatgctcttctaaccaggcaatcatcttatcaatcgcttcttgttttcctagtccatctaaccattgagaattaatatgtaatccatcttcagtataagcggcttcttcaatatttccgccttctaaaacaggtatgatctcaattccaaactttttagcaaattcccaatcgcgatcatcatgtgctggtactgccataattgcaccagttccataacttgctagtacataatcagaaatccagataggaattttcttaccattaacaggattaattgcatacgctcctgtaaaaacacctgttttatctttgtttagttcagttctttctaaatctgatttacttgcacaactttctttataagcttcaatagcttctttttgttccaatgtagtaatttcagctacatatggatgctcaggtgccataacacaataagttgcaccaaataaagtgtcgcaacgagttgtaaagactgtaaatattttatctgttccatcaatcctaaaatcaacattagctccaactgattttccaatccaatttcgctgcatttgttttgttgcttcaggccaatcaagatcatctaaatcttcaagcaatctttcagcatattcagtaatttttaaaacccattgccgcatcggcttacggataaccggatatcccccacgttcactttttccatcaataacttcttcatttgctaaaacagctttaagttctggacaccagtttacaggaatttcatctacataagcaagaccggcatcataaagttttgtaaaaatccattgtgtccatttataatattcaggatcactagttgcgatttctctatcccaatcatatgagaaacctaaagatttaatttgtcccttaaatacctcaatattctttttagtaaattcagctggatgatgtcctgtttgaatagcaaactgctctgcaggaagtccaaatgaatcaaatcccattggatgtaaaacattgtatccttgcattcttttcattcttgaaacaatatctgttgcagtatacccttctggatgccctacatgtaaaccattccctgacggatatggaaacatatccacacaataatattttggtttactatcatcgtagcagtctgttttaaatgttttatgctcatcccaatatttttgccatttcggctcgatttgtttgtgatcaaacggcattttataattcctccttaaaataaaaaaatcatcctatctaaggacgacttttaatcgcgttaccaccttagttccaagtctaaaagacctagccctcaaaactttaacgcagttaacgacaacgactacttaattccccgctgcatctcctaggtgagttcataacccgttttatcagtttccaccagccactgattctctataaaaaacgtcaattactactagtcctattcatcgactttcaaatactagaatattataacataaaaaggctgatatgcaacaaattttattactaataatttggttgttttaatgctttaataggatctaaccggcctgccaaaaaggcgggaatatagctactgcacaatccaaaacataatgctcctaaatagatagcaattactaactgataatcaatttgaataaacgctcctgataaatcaagctgcagctcattttcaacaagctgattaattaaattaactaattgataaaaaaatacataagagcagataaacgctccactaattaaagtaaaactttctaataaaactaaattcatgatctgtaatttactcgcacccatacatttaaaaataccgatatcttttgttttttctataacggacaaatataacacttccccaattaagaaacatgctgctactatagccaataaagaaaatagtaaaagaactctttgaatttgtaacataaatgtatctattctttcattaatattttctcctgcaactttaaattcaaattgactatactgatcttctaaatccattaaaagatcatcaagatccgctttgctatttaaattgatcatagctaattgaaacaataattgtttcttatcaatcgcaaaagcttggctaatatgatcgagattagctaattcattaatatagattgtgtcaaaagcagttacatctttccctattccaacaacagtgagtgagactcctttaatttgatcgtcctttaaataatatccatataattgttgattcaataatttttgataatcaggattaagatgtgttgccgttgtttttgataaaactatttcattactattttttgtttcacgtcctatttccaaattcctactttttattggtttagtcatatcactgatataaattgttttttcaacttcataatcactttgcagtgatactcccataaattcataatcggctgattccccatagataaattcattcatatctaaatttgataatgaaagtaactcatgataactaagtaattttttatgtacattctgaatcgaaattagttgatttggaaatatagaatcaagctgtctttttatttgggtttgtaatgatccactcagtgtaaaggtaatcataatacaaatcaaagctactgtaataccagatgatatttttaaatttctacccaaattagcacgatattgtaacaatgccagttgatataattttaatggtgaatgctgtttgactaaacgcgaataaaaatgattatttttatcccggcgatacttcccaatcaattgtccattttgcatagaaaagcattgatcagcatattgataagctaattgctcattgtgcgttataacaatgacaagtcgttccttagcttctgcatgtaataattcaaaaaccatctttgcatttttatcatctagagaacctgttggctcatcacacaataaaatatcaacatttttaatcatcgcccgaagtaatgcaacccgttgtttttgtccaccagataagattttgaccctttttttattcagttttcggagttctaatttttcttcttgatcttcaactgctcttttatatgaaattttagtaaaaaattttgctaacaaataattttctttgacatttagccaattaattaaattgaaatcctgaaaaataaaaccaatatgcctacgacaatactttttaatttttcgaatatcttgatgatcaaataatatttctccttcataatcttgatctattccaccaattagatttaataatgttgtttttccgcatccagaatttcctactattatgatcaatcccgtacttggtaatattatgtttaaatttttaataatagtttcatcatatcttttagttaaatttttaatttccagcattttagttctcctttaacaatatgctaatatccattctgtttattttaagactagcttgtaaccctgctaaataacatgcaattatataaataacaatcaacactacatataaatcatattttgtaaaaatatatttcggtaagacaaacaaccttggaatgttaaataaataatcacttaaatcaaatagctcaattaatcttaatacgcccattgctaagattgctcccgcacttccaatcagccctcctatcaaaattgcttcacgacaaaataaattaattgctttacctttaccaagaccattagccaataaaagactagtatctctttttcgttcaataaaaattgttttaagaataactgaaattaaaattaatgaaatagcaaaactaattacaataaataagaaaatcacaaatctagtgatatcaaaaattgatcgatagttgtcaatataatcaccgtgtagattaatcagcaaataatctttttgatattcttttatcacagcatctacttgatcactatgaaatattaaaactgttttatccaggcaatcatcacttaactcttcttctaaatactgttgttctaaataaagattaacccctatattaatatgatcattaatgattccactaatagtgaattcatattcatcatcattaatttcaaaattaattctctcgcctatttttaatttatacttctttgccgttgtctgattaattaatatttgattctcttttgaaggatatttcccagaaatataatctaactttttagttttaaatatctgatatacctcaacgtctaactcttcatcataactgcttaaaattccattactaaatactaatttgtaagcaacatttgctattttattattcttctcaaattttttaatttctttgcgttcaaagatattattaatataatcattttttgaaacttcaataactctttttaatgggtcttcttcaaattttttttctaaatattgccatccaccattaaaagcacttaataataaaacaaaagctagaataataaatatttgtgatacaaacatcattattatctttttaaattgatatttgagttgccttttacaataaaaaagcagtcgacctggctgcttttttatgattattggtgaatatttatgatatcgttcattactaaaattataataattcttttttttatcaagatctacaatcatttttgtatattgtttaattaatcgagaattatgcgaaataacaatcactaaatgctccttggcatacctttttaaaagtctcatcacttcaatacttaatttatcatttaatgctccagttggttcatctgctaaaagaattggtgtattacacaagaaagctcgaaccaatccaattcgctgcttttgaccacccgatagttcatcgggatatctttccaacaattcaactacttttaaagttcgacaatactcctccaattgaccagacacttgctttaaatcaataccttttatttttgtaattaaaattaaattctcttttattgttaaagcattgactaaattataaaattggtaaacataactaatataatcacgttgatacattctaatttgttgatagttgagcctatgcccatcaattaatacctgaccattgcatggacgctcaattcccgcaataatgtttaacaaagttgatttccctgtaccactttgaccaatgattcctatcatccctctacttggaaatttaattgttagatcatcaataacgcgttgtctcttttttccatacttataaaatttagtaatattaataagttgtaatgccataacgtcctccttatgttataatagcaatggtgataaaatgaacttatttaaatatagtgatgataataaacgctatcatacttttaattattatctgaaaaataaatatcaaagtaaagttgccaaagttagtttgaatgcgggctttacttgtccaaatcgcgacggtactaaaggcacgggcggctgtattttttgtagcagcactggttcaggtgattttgccggaaatatccaggattcattagaaatacaatttagtaatgttagtttgcttcttcaaaataaatggccaaattgtaaatatattgcttattttcaagccaatactaatacatacggcccattaaaaaaaatcaaagcttgtatcgaaccatttatcaataaaaaaaatgtggttgcaatcagcatcgcaactcgtccagactgcttggaaaccgatgttttaaattatttagcagaagttaataatcgctgcgatttatgggtcgaattaggtttacagaccattcacgatcaaacaggtgaactaatcaatcgtggccataattatcaagacttcctagacggcttgaataaattacgaaaattaaaaattaatgtctgtgtacatattatcaatggtctacctggtgaaacatatgaaatgatgcttgaaacagcaaaggcggttgggcagttggacattcaagccttaaagatccatatgctttatgtcattgaaaaaacaaaattacatcagttatatttacaacagccttttaaaatcctgagtcgtgacgaatatattgatttagttgtcaaacaattaagttacatcccagaaaatattgttattgaaagattaaccggagatggaaatatttcagatttagtcgctcccttatggtcaattcgtaaagtaactatcttaaatgatattgataaattaatggttgctaaagattattatcaaggttgtaaaataaaaaagcccatttagggctttttctattattcaattattaattactagtttcaattaaaccataatcaccatcattacgacgatatacgatactaattgaatcactttcaacatcacgataaacgaagaatgaatgaccaatcaattccatttgcatgattgcttcttccatatccattggtttaggggtaattgacttaacctttaccaagacatcttcttcagattcaacatcttcaattgaagataggttgaacgcaagtttattatcttttgatttacgacttagtctagttttgtactttctgatttgtccttctaatttgtcaacaactagatccatagcattatatagatcatcatctacgacctctgctcttaaaagtacatattcagtaggaatcgtaacttcaagtttttgtccataaggataaactcgacataaaacttttgcttcaacattgtcacttacgatgaaatacttatctaatttagatagtttttctgaaatctttgcttcgatagcctctgtgatttcaatgttttttcctcttactgagattttcataagaattcctcctttgtataaacatattatacaatatatatttgtaaaataacactcaaattattgataaaatttccctaaatttaacataaacaaaaaacactcgaataaatcgagcatttttatctataaatatttttttagaatttctactttatctaactcttcccatggaagattgttatccccacgaccaaagtgtccataagcagctgtttttagatacaatggttgacgtaaatctaacgttttaatgattcctcctggagttaaatcaaagttatctctgattgcttttaggattatatcatggtcaacatgttcagttccatacgtctcaataaaaattgaagtaggttctttaactccaatagcataagaaacctgaatttctaatttatcacaaagatttgccgcaacaatatttttagcaatataacgcaacatataggcagctgaacggtcaactttggatggatcctttccactaaaagccccaccaccatggcgagcagccccaccatatgtatcaacaataatctttcgcccagttaagccagtatcaccatgcggtcctccaataacaaagcgaccagttggattgatcagcactttataatcagtgtttaaattatattttcttacaactgcatccattatttcttctttaatataacgtttgaattcagtttcatcaaaatcaggatcgtgctgaatcgacattaaaatagtatcaattttaggagtactttcggtataatcaatcgttacttgagctttcatatcaggacgggctgacttaaattctccagtatcctttttttcagttgcataacgaaccaaatgatgagcaattgaaatcggcaaaggcatatacccttttgtttctttacaggcgtaaccaaacatgattccttgatcccccgctcctccaacttcatcatttgttcctaaagcaatatcaggagactgtaaatccattactacctgaaccttgcaagtccgataatcgattcctttatcgctatcatcatatccaatgtcctttaaaacatctcgagctacctgctcatagttaacttctgcagtagttgtgatttctccaccaataactaccagatcagtagtagcaaaaacttcacaggccacacgtgaattaggatcttcttttaagcacgcatcaaggatagcatcactaatttgatcacaaactttatcaggatgcccttttgaaactgattcagaggtaaataatactttttctttcatttttctttctccttctacaaataaaaaagcttcctaaagagaaagcatacatagttaggaagccttctctcattgttcaagtataaacttgctcagttaggcaccttctaatttaatatagggttgccactacatcatcgatcttcatctagtagttcttaataagagtcttttttatttatttgttctatttcttctttagttagtgacgttattacctcaataatatcgtcatcgagtccaatatctaataagatactggcaatcattttttgttgccttacattcttcatattatcaccttaacttagtttgcataaattaaaaaataatattccttaaaacaacaaatacataataatatatctaagacattattgcaagcaatttattagatactaatattttagcatggaatgaatctttttttgtctcaactttgttttaaattaatactcagttccttctaaaatattttgcactcctaaaactcctggtacttcttccattaagatttgctcaacaccatcctttaaagtttcatctaacattgaacaacccgcacaggcacctaacatcttcacataaacaatgccatctttaaaatctattaattcgatgtcaccaccatcacgatttaagtacggtcttaatttgttaattactttttctacttcttcaattgtacttgtattttccattgtccttcactcctttagcacttatctattttaccacaaaaaaattatttttaaataaatatacactttaattaagaaaattactaggataatatgattttaactaaaaaccataaaaatcacttagatgatctatattataatcgactaactgtcggatgaaaaacactgtaatgacggtgttgtaaaacaagatacttaataaagaccattactactaaatatcctatcttcatcactattaattcttcatcactattaattgtttaacttttttattttttttatataaaaaaatgactgtttttcttttgcaagaatatatcagctattacgggataaaaaatagtgcattattttttcattcttctttttattttgatataatatatccgggaaatgagtataagtcccaaaactctcatttctcaaacatgcaaaaggacatgtaacacagataaagagccccactaaactgaggttctttatctgtctgacaaatgttctaactacgtacatatatgctaaaattacaaagctagacacaatattttaatttaaatataaggattgatttctcactcataatgaagtcaatctttttaattatgttttgattttttgttcttaataacaaaaatatccctctatttcctactctgttctaatgattcatattcataaaatatttcattcttcataaaaaatcctctatgacttaattaccaaaacaaaactttactataataccttcgcttctatcaaattttagtctctctattaaatcattatactatctgaccgctaccaaaattaacaaaaatttattgtaaaatattttttattagatatttcaatattacattttaacttcattaactattcagcagaacgaaaagatagcgttttcaaattactatgttataataaaagaatgatatgtgtgatataaatgtgatatatcaggaggggtggttatgatgaacaataaaaatactgcaaagaaaatgtcgattaatgaaaatgctattttagaaaaatatttaaatactctggcaactccaattagtaaacacaaacctgataaaaaactctcatttatatgggcaaatgatgctttttataaaatgaccgggcatgaaaaaaaagattttaaaatgatttggcaggatttaaaaacatactacaaaccttatacagatgattttattattcttgaaaatcaattagcaaagttgcaagagcatcgtgatttacatcaagaatgtataatccgaattccttttagacatgatgaaataaaatggattaaattatctatttcactttctttcgaagtaataacaattgcatataacgatattagtaatttaatcaatacacagaatacactcatttcaactaaaaatgtatatatagataactttcaatggatgattgcagaaaatgccggaaatgtttatatcagtgatattgacacatatgaacttctatatttaaataaagttgcatgtgaaacgcttggtactagagctgaacaagcaatagggaaaaagtgttatgaaatcatacaaggtagaagttccccctgtcctttctgtacaaataaatatttaaaaaaagatcaaacttatgaatgggagttttataaccctttattaaaaagaaattttattatcaaggatcgtatgttgaattggcatggccactctgcccgtattgagctttcccatgacacttatagtactgaatataagctagcaaagaaagatcaagaacgagaagcaattttaaaaaccatttctgccgcgatggtacgtgttgatgcaaggaattattcttcaattctctggtgcaatgatatttttcttaaaatgattggttatacaaaagaacaatttaaaagtgaacgttatgagttaaaaagctatatgcatcctgaggacttaaaaagagccaagcagattgttcataaattaagaaattcaaaagagagcgttgtattcgagggacgagtctatacccgtaataaagaagaacgtatctggacactgacattatgctacgtagatgaaagggacagctgggatggtatcccttgtttttatagtatgggtctagatattacagatgaaagacaaaaaataaagacattacagcataaagcagaaaaagatgcattaactgggatatacaaccgctctgaaaccgaaaatcaaataaaaaactttattattgaacatcatgactctaagggagcactcttcatgattgacacagataattttaaacaaatcaatgatacattgggacatattgctggagatatggtattaggtgaaatggcaacggctatgaaaaagaaagtacgtgatagtgatgtcgttggtagaattggtggtgacgagtttattattttcatgaaaaatattactagccacttagatgcagaaaagaaagctgaagaactacaaaaaacatttgcccatctatttgacaaagagaaaagtaagattcaggtaacaagcagtattggtatcgctttatatccaaaagatggacataattttttggaattgtatgcaaatgctgataaagcactttaccaagccaaaatccaaggcaagaatacatatatcgtatataatgaaaaatcttgtaatcagcaaagtattaccgcatattcttcactaggtgcaactatcgattcacaacaatcttatagtgaaacatctgtttcattagcagattacgcctttcgtattctatttcaaaacaaagatttaaaaacagctgttaatctgattcttgaaattactggaaaacgctatgacgtaagccgtgcttatattttcgaaaccatgacagacaaagaacattgctccaatacatatgaatggtgtaatgaagggatcaccgctgtaaaagaacaactacaaaatatttcttatcatgatatggatgaatatgaaagagtattcgatgaaaattctatcttctactgtcatgatgtcacgtcattaagcaaaaaacaaagacaactgtttgaagcccaaggaattcattctacactacagtgtgcgtattatgagcaggaaatgattgccggtttcgttggctttgatgaatgtacaggaaaacgaatatggacaaaagaagagcttagaatgcttactctcatatcgcaaattatatcaatctttctaaagcataaaggattaagtgaccaagtatcaaaattgtaatctagttattgttttagactactaataaataaaatatatcagtaatttaaagatatttagaaaataatcttatatacacaaataggctgggcaataattccagcctatttatattcattaattctctaatcgtcttttaaaactagtaaagccatcttacttctaccagcaaatcattcatttccttttcacataattttagaataactattcttctactacattctttaaattgttattcctggttctagatggcgcaatactttattcttagcttaaatttaattttaacatccttaaaaatgtattcttttacttaataaaaaaatatactaaatttattgaatctattgccttatcaatgatttttgtattatttataaaaaatgaaataattttatttattttgtgctataatatccacgcagggagtgattattaaatgagccaaaagattaaacgcggtgatatcattgatgtcaaaattactggtatccagccatatggagcttttgccagtttaccagataattcaacaggattaatacatatttccgaaatatctgataaattcgttaaaagcatcgatagttttgttaaggtgggtgaatcaatcaaagtaaaagttattgattttgatcaggaaactaaccatgctaaacttagcttgaaagccattgataatcgttatcgtagacgcaataaacgtgtttactataagaatcctagacgattaatcgttgaaacgcctaatggtttcaaaccattagctcttgccatggaaaaatggcttaaacaaggaatcacggaggaaagttaaaatgattacattagatttatctaaagctaaattaagcgaggatttagaatcatacaaggacaaagtaaaagaaatccatgatatgattcacaacaaaactggagctggtaatgattttcttgggtgggttgaattacctgaaaattatgataaagctgaagttgaattaattaaagaaacagctgctagtctaagagaaaaaacagatgtgttactagtttgtggtattgggggatcttacttaggtgcacgtgcagcaattgaagcaatcaacggattatatccaactaatgatgttgaaatcatttatgtaggaaatactttttcatcaaattatattaaacaagtagctgattatattaaagataaggattttgctatcaatgtaatttctaaatcaggtacaactacagaaacttctatcgcatttagaattttcaaagaaatgtgcgaaactaaatacggtaaagttggagctaaagaaaaaatcgttgctacaacagataaggctaaaggtgcattaaaaactttggctactgaagagggatatacgacatttgtaattcctgatgatgttggtggccgttattcagttttaacaccagtaggattattcccaatcgcaatggctggaattgatgtagatgcaatgttaaaaggtgctaaagatgcgatggaaaaatacggtaatgctgatcttgatcaaaatgatgcttataaatatggtgttgctcgccagattttacacaaagccggataccctgctgaaatgtttgtaacttacgaattacaactagctatggtagctgaatggtggaaacaactttacggtgaatcagaaggtaaagaaggtaaaggtatcttacctactagtgctactttctcaactgatttacattctttaggacaatttatccaagaaggtacaaaagttctttatgaaacaatcatgcaaattaaagaaccagctggagatatcactattcctagtgataaagatgatttagatggtcttaattatttagcaggtaaatctgtagactatgtaaataaaaaagcttgtgaaggaactgttgatgctcatgttaatactggtaatgtacctaacattttgattactttagataaaatggatgcttatggttttggttacatggtatatttctttgaaatgtcatgtgctatgtctgtatatttacttggtgttaatccatttaatcaaccaggtgttgaagtgtacaaagcaaatatgtttaaattacttggtaaaccaggctattaattattatgacgatctttgatcgtcttttcttttgcataaatatttaaaatatggccaaaatgtaaaagaagtgcttattatattaaactaattataaaaaaattaatttattataattttttttattgactaattgaaaagtaaatgataatatatttaggcaccaaggcactggaggtttagctcagttgggagagcatctgccttacaagcagagggtcagcggttcgagcccgttaacctccaagcagatgttgaagctccccataaaaaatcacttgggaatggttttagttttttgtgtaacattttatttcctccttttaaatatacggttttatagtaatttaaaacttaattattttcaatcggttttccaaagaaagaaacaatgtgacataatttaaagaaaataagtaaaaaatatgcaacattgttgcatatcactttaaatatattttttcatattcgtcattaaattgaacaatcgactgataatcgtctgtaaataacaaagaaaatagacaattaataatatattgagcagaaacctgaaaaatcatatctcttaattcaacaaaagagccaatatgaatcgcagataaaatttcatcacaatatcttgcaattggactctcttttctcccagttattgcaataatttttatttccttatttttatgtaactcttgaacaactttaagaatcttttcatcttctcccctacggctaatcacaaaaacaacatgctcctttaattcagttaaagttaaataaagctgctgatttgatgttgtataattattagctatctttctctctaagaaaaataaatgacatgcataatctgcaatacatgcatttgcatcactactaataaaatcaatatatgtagttttctttaggagttctgctatatattctatttgttgtaatgataattgattttttgttttttcaatgacatttttttctagttcactaattttatcaacaattgaaatacttttttctttttctgtaattttaatatcagcagcttgatattcttttaaatcatgaacaagatgaattttaaaatcattataattttcatatccaatcttttgcacaaaccggataatcgttgaagcatttgtataagtttcttttgctaatgctcttgcactcatcttaacaacatcttcactgtgatttaaaatatactgacaaattatattttgcgtttcattaaattgcttactgtcatttagcaggtctactaaattcatattaatcacccactcatattttacaataaattttctaaaaaccaaacaattataattctaactgtagttatttcattaaaaatatttaaatttaataaactatcctaatcttgagtaaaaacaattcttttaattttaccatttgcctcacgttgaacgcctctagcataacgaatttcaggataaccaaacccaaccattaaactaatataatgatcctcaggaatttgcaataatttcattacattaggcatattacctagaactgccaatggataactcatacatattgcgcccaatccatttgcattacataacaattcaaaatatgcagctgccatattaacatcctgaacagcacaaggaatattttttggtgcatgaggaatcaaaatatgcggtgctccacaaaaaatagagtctggccgaactgatttttcccatgccatcatttgattatatgaagttttatcaaacccttgtggatatatgccattattagctaatttaatcatttcatctctaactaataagcgaaaatagtccatttctttacaatcatcaataatggtaaactctaactttcgcttattgccaccagttggtgcatattgaatactctccattaattcttttataatttttttatcaacatctttattaagataacgtctacaagcacgacgagtacgaaccaacgccgacatcattttcccagcatcttgataatctggtaaagttacactattttgaggatctttattaaaaatagaaattgccccagttggacatacagccaaacaatgatcacactgccaacatccatcccaaccaaaacaatcaatttcttttatttttaattcattcttatcatcaaaaataaacaaatcgcctggacaaaccttcaaacattttccacaatgaatacatttttcaagactccatttaaaattagtaatattcataaatattttctccctttcaatagaattaattttataatttttaagctactattataatatcaagtaattattgattaaaaaagaaggcacttttttgttagaaatgagatttataacacaactaccggcttagctctatcttgcttaaatgactctaactatttataataaaattaacttatctaaaggagaacaggaccaatgataaaaaaagaaaacttgccagaatgtccagttgcaacaactgttgaactaattggaagcaaatggaaattattaattctgaaatatcttcttaacaaaacaatgcgttataatgaattgaaaagagaaattgatggaatatctcaaaaagtcttaacctcaaccttaaagtcaatggttgaagatggaatcgtgattagaacatcctatccagaagtcccaccacgtgttgaatatagtttaagtgaaattggtgaaagtatgcgaccagtaatcgacgtaatggctgattggggaaatacatataaaaataaaaaataaatttgtgatatatcaaaaatgattcacatatgccattatttccacaagagttaatataaaatacatatatgattttagtatttaaaactaattgaccaatttcaaagatgttagtatcctatttacttttatttaaattaaaattactattgtaacttagccacaataatagtcaataattttatttaatatgtctctcatttatacaatgactatcaaaaataatgaatatttgttaaaatcaaatagtaagaggtgattaactattgtaaatcaaacgatttataaaaaaatttatatatagatatcaaataacgccaaaaaggagtttttcaactccaaaaaaattaatagtgacaactattgattattattttaataatttggaatcaaaatccatgccgttttttctaggtaaaaaatgatacggataagttttctagcaaacgtgagtctgtgcaactcgccagtgttttccttctttgattgatagtcatatataacaggattgtttaatgcaaaagtatctacaacattcatgataatttgacgaagatgagaagagccatgttttgccatgtgacctttaaaattatcttgtccagactcatttctgaatgattcccgcttcaatatcttttattttagcattaatatttttgtagatttcaagcaaggtgctatgactggttcgaagtagatttgtagtcaacggtcgtaagatatcaaggaatcaaaacagaatcaatcttatcagttttagttttcctaagagttgaggctttggaaaattgtttgattaaaaaagaattaatctccataaagtcaaaattgtaggctttgaggaattgtttaaggctgcttccataatgaccagtggcttcaaaacctatttttattttttgattcttatccaaaaaatttaagaataagaagcaattgattgaacccattctagttattaacgaaagtaaaagaatgacgaatggcttcaccattatgatcatgaatgaagcagtcatgcttgtatttagcaatatcgataccaactaaataagttataaaaaacctccataaaataattcgcactgtcagtaagaccacaagttttttcttcatgtattcacgttgttcataaagcatcgagtgctaattaacttaatcaacaatttgaaaaagaactgtggcaggtataacctctaaacagtcaagctgtagaaaaatagggacaaatccacagtgctaataaaattatatcatcattggccctggatgatataaatgtatataagggcagaaaggagaatactcaacttagtgacctaaattgagtatacgtgataaaatggaaataacaatggaaatcttatataatatcttagatgcttatgcttatgaaatagtcttcgttgatcgaaatcatattgtacgctatatgaataaaaccgcaaagcaaagatacggctcaagagttcaagttggcaatagtttattcaattgtcataatgaaaattcaaagaaaagaattgaagaatttctagaacgcgccgatgctggtgaagaagaaatgtttgaagttcttaatggtaaaactggagaaagagagtttttcgttcctgttaaagatgcatcaaaaaaagttattggctattttgaaagacatgaaatgttctggtcaaaagacaaaccagaggctcctatatttgaatattggaaatcaaaaaattaaataaaaaagacagcaatatatcttactatcttctaaatatacattttgtattctattagaaaagaaattcatatgactgtctttttatttgttttaaatgattaaccccctaccataaatttctaattattattttataatggcaagtctttttttgaaaccatataataccgattatatataaaataattgcaattaacagcatagccattaatccgcttttatatccactaacttctaaaatactttttgtatcatataaagtattaaatgtaatatatttcaaaaattctaaattttctgacaactttatcaacataattactacaaaaaatacaacggaatacctaccccaaacatcaatgagttcttagaagtattaaatatacatgatgaacaaaaacatataccgcttattcccagctgatacaaaaaagcacctaaatttatcaataaaaatgtatcaatatcaagaccagacagtttcgcagcaagatgttctcaaaaaaatatttttgatttcatcaaacggagtttttaattcattaaaacaagaacttgataatttatatgaaaacaatgatattttaacgtgaaaaatcttatattctgcataataaaaagcctagttgaaattgctgaatgcatattcaatcaagactttttatcaaaaacaattatttagaacattctttaacaagaaattcataatgatcctcatatagatctaaaataatatatgttaagggcaatgagaaacgtttttttccacaacttccagggtttaaatataatgttctacctttttgataacatgctaattgatgtgaatgtccataaatataaaaatcaacatcctttttagtgtctaattgatgaaccaaataaaatgaataacctccaatattaaaatattcttcttcattcagactcagcttgtcattattcccctttacaacaaatacctttgtaattgtttgtagacgctccaatatttttatatcaactatatcaccagcatgaataatataatcacattgtttcagttcatttaacacttcttcttttaatatgtcatgtgtatcagcaatcactcctactctaatcattatcatttcatcctttcccaaaatagcaaacgcctcatcttctatatgcttcttttcaaaaattaatataacaaagttattctatatttacaatcactcatatcatgaaaaataaagtatccaatataaatacttaaaaaatttaatattagcatatttcaatcgggaggaatacaaatcagctgaatttattctatgaacccccttcctttaatgctataatcataacaaacaagaaataataatagttattttaaatatgaaatgatcacaaagtacaataatttaataattaaaataatagactttatttcctgtttcataaatttattctaaggagtaagtaaaaatgagtttaatcgataatttaagtaatgagaaactttttacaaaaagtgagatcgaagtcatcaattttattaaagaaaatcccaatctagtcttaaatatgacaattggagaattagctaaccaaacattttcgtcaaatacaacaattataagaatttgtaaaaaactaggatttaatggctttagagatttcaaaatagaatacctaagaaatatcgaatctttaaaatatctaaataacgaaactgatttcactctacctttccaagaaaatgaaccaacctggcaaattattaacagtatttcaaatgtctataaagatagcattaatctaattaacagtgaattaaatattgctgaattagaagatattgtagaagttcttgatactagtccacgaacttttgtttttggaattggtgattctaaaattacagcgatgaattttataaataagctagttaaaattggtaaatttttcattttgacaactgaaaataatgaacaggaatctttttgtaaaggaatcactaaggatgattgttgtttatttatcacttatgataaaaatgaatcctataaagcctgtttaaaaattctttttcaaaaacgctgcaagatcattgtcattacttctaactgtgacaatccattagtcaaatatagcaattatcatataattattcctcataaagaaaaagatgaaaaaattgctactttttattcacaacttgcatttaattatattcttagtattatctattcactgatttataaaagaaataaacactaataacttacataacataaaaacgatagtctttaatcactatcgttatctatgttattttttaataaaaaatcatgtaattccttatccgttaaatcttttatttttgtttgataataacgcattgtatctttagttttattgctgatataagcattataatcgattttttcattataaataccgtagaattcatatacatatgccatcccaccttgttcactgatactctttttaaatgttttaataatattttttaaatcaaggctagtatcaatataaagaaaaacctttggcccaacgtttttaattttatagattgctttaattccttcataattacgattgtttatccactctaaaagttttttatatcttgctgcaattaatacaataaccataatttataattctccattccttattactattactctaatctcaaatatcttatattttacactatatcaaattaaaaaacattattttttcatatatccaaaaaaacatctcggattgagatgtctttaataaaatatctatcataaatactgatgtatttttattattcactaaattataaaattattttactttttagtaactagttggtaactttcatctaataatttttctacttgtgttatctggacagtacgatcaagtaaaatactgatccaatgctttttattcatatgataagcaggaaaataatgaatatgatcaattaaggtattgattttttcaggtgtatttttaacatttaaaatatctacttttccttctttatcaatatttaaacatcgatatgggatatttataatcaatccataccattttttagtttctaatatttttaaggtagctgacattggatcacgtgtccacggataatctgcttcagtttgatatttatcatttacataagctaatatcttttttctaatactaattggtttaaagcatgattttaagatttcatccgttaaacttgcaacttcttcctttatcagtgcagtatagcccccaactacattttttatataaaaaggtaaaaatttttcaccgttattttcaaacacatcaatgttgaagcaactattacttatttcaaaacgagcataaaattcattgtttttcaaagttttttcaacaataaaaagattatcaagacgtttgaatccatattttactagggcattttcttgcatataataattattaagtacctcatctctatccatgatctagtccccctataattcatcgttactataacattatagcgtatctagtcattgttttatagtcaatcttatcttacttatatttctttaacgggtacatcttattgataatatttttaaaccactcaatattttctattacttgtaaagatgtaatagtaccttgaggtttatctaataaccgccaatgacatggtaatgttagttctaaaaaagtatagccgttggcttcaagttggtgtccaattgcctctttcatataacgctttacttcagtaattcgtttaatatctgtaaaacttccacgagcaactaatgcagcgtcttttgaaatacatagtatttcgcaaagatctatagcatattcatcagaagttggttttaattttaaattagaaaaataattaagcatgtgaaaaatagtaattggtgtattatcaagttctttaaaatcactgattgcttgtttatgctgccatggctcttcatcagtataatatacaacaactatcttttctggatgattatgtttatactctaacgcatctttaagataattatcacttccgtaaatttctacgtttatttcaaaacgggcatcttttgatttaaatataactaatttattctcaagtttcatcgcttcacaaacctctgccaatagccgctcaatcatcccttgataacaacctgtatgaaaaggaatcgtcactccctttaataacacgggaaaagtactcttttcttcatttttaaactcaattgcaagatatgggcaaacctgttgacaaatttgacacctagtgcatttatcaaaatctgtgattacacaatgaccattagaaatttttaaaattttttgtggacaattaatcgtacaaattccacaacctgtacatctattttgattataaactcgtttcaacattatcattatcctccgtgtttattagatttttacccttactagcaattacttgttgataccagtaaaaagattttttcttagttcgagttaatgttccattaccaaaatcatctaaatcaacataaacaaaaccatatcgctttttcatttcaccagtacccgccgaaataatatcgattggtccccacattgcataaccaaaacaatttactaaatcaatctcaattgcttctttcattgctcgaagatgttcttgtaaatatgaaattcgataatcatcaataattgtgccatccttttctatttgatcaatcgctcctaatccgttttcactaataaataaaggaagttgatagcgatcatacaattgatttaaagaataacgtaaaccaacaggatcgatctgccaaccccactcagtcgttgttaaatatggatttttcccgccagaagataaatttccctctaccatctcaatatcagctacgccttcaacagcagaaaaataataactaaaactaatataatcaactgttccttgaagcaaaatttcttcatcaccggcttcaattactaaatgaccattacatttttttaaataagatttacaagtatttgtatagtaacctcgcacctgaacatcaccaaaataatatgttggtaatagcttttcacgggcaatcacttgatctgtgggattacaagttgccccataggtacaagggtataataacatgtttccaatcataaaattaggattaattttatgtccttctatgacagttaaagcacttgccagcagctgataatgagcaacctgaaacttaacttgatttaaatcttcatcttgctgatagataattcctgccatatgccatggtcgatcagttaaaaagagtgcattgatttcattaaaagtcatccaatatttaactttatttcgatatcgttccatgaccgtctttgcatatctaaccgataattcaactaattttcgatttctccatcccccatatttttttactaatgataacggtaattcaaaatgatgcaaagtaacaattggttctatcccatatttgattaattcatcaaatattttatcataaaattctaatccagcttcattacattccaagtcatctccatttggaaaaatccgcgaccaggcaattgacattctaaaacatttaaatcccatctccgccattaaatcaatatcctcttggtaatgatgataaaaatctgtagctatatgacttggataataagtatctttatgcacatattcatgaatttccctgatttttccatgtcctgctcccaactcaacatcattaatactaagacctcgaccatctaaattatatccaccttcatattgattagcagcacttgcaccaccccataaaaaattactatccatgcttatttcctcctcgacattataaattttatcaagttattttaaaagactaaagaattaaaggaaatgttgtatcaagattacgctttttaataaattgaaataaaaaaagcggaattacgttccgctttgagtattatcttctttcattatctctaacgtagactcccgtcccacctctgcttgtttcgagattgcaattcgtcgagctaaattatcatcatacattaaattaaaataacatgaatacaaaatatcaagaattagtttaatactattttcattagaatatccagcaatttttgaatataatttttcacgagttgaaatatgaaggacaacatcagcatatttttttagctcattatcccctaaacttgttattgcaataattggcacgcttcttccttttaaagtcctagccaaactacataaattatgaatttctcctgaatacgaaataatgattatgcaatcattatttttaattaccgcaggtaaaaataactcttcaccattagtgttacaaatattaacattttttccaattctaagcatgtctaatttaaaaatttgtcccaataataaagaataagaaattgccgctaaatgaatttgattagccttctgcataattcgaagagctttttgtaaattatcatgctctagcaaagctaatgtatctgataatgtctcttgtgcaagtaatgttactttacttgcaattttttgaatattatcagttttaacaaatgggaaattgggatcaatattcttaaaatgagtatctaaataataaacttcttttaaaaaatcagccttaaaatcttcataaccatgatatcccaattttttggctaatctgataatcgttcccgttgatgtatatgttgctacagctagttccttgattgtcatatcctttatattacttcttttttccagaagataatcagcaattaattgttggctttgagataatcttgcacgttctattttttgttcaatcaacatatatttccacctcatctaattttattctattataagtaatgataataagcaaatattgaatataataaaaataaaagaactaaaaagtcaacttagaccttttaattcttctattatagcctatttttcaaaatgagtagccacttcttgaagtccttcaataatatttaaatgttgtggacaaacattctcacattgaccgcatgcaatacagtcacttgctttaccaaacgtttttgtcagatttgcataatattcgccttgtggagtccagcccttttctgctacttcttgtaaatctgcattatataatgaaaaatattttggaatattaatattcattggacagccatctgtacagtacgaacatcccgtacaaggaatttttatagtagaattaatagctgcaactgctttattaataagtttgtattccttgtcatttaaaggtttaaaattagccatatattcagtattatctaacaattgttccatattagacataccacttaataccatgactacattatctagactagcaacaaaacgaatcgcccaagatggaattgaactttgtggagcatagtccttaaacattttcgtaacttcctcaggtacatttgctaatgttccacctttaaccggctccattacaataactggcttatgatgttttgtcgcaacttcataacatttacgagattgtactcctgcactatcccaatctaagtaattaatctgtaattgaactagttcaaattcagggtgctcagttaaaactttatccagtaactccggcccatcatgataagaaaaacctattttctttactaacccttgttttttcttttcaacaatccaattaaaacaatctaattcattataagtatcaatactatgggtattaatatcatgcaataagtaataatcaaaatattctacccctgtcttttttagctgctcattgaaaatgcgatcacgatcttcttttgattttaaaaatcctgcatgtaattttgttgttaatgtaaaactatcacgaggatagcggtccactaatgcttctttagcagcattctcacttgcaaaaccacagtacatccaagctgtatcaaagtaagtaaatcccctttccaaaaatagatcaaccatttgctttgtttgttcaatatcaatcttcgctggatcattaggatccaatgaaggtaaacgcattaaaccaaatcccaatttcttattatccatattttgcccttcctttcaaaactattataagccttaaagcatactttagcgcaagaatttttttaaagataatataaattatttactaatacaaagacagcatttttgcttatttatcatttcaaatttttttagtgcagcttctattaaattatattgataatcataaatatttagcaataaaattgaaaaatcctgcataatttcataattatcaaattttttaaaaataaaataatctgcttctaattccttaattaataaatgacattgattagatggtactataattgtaattactttcatctcaatactcctccataattgttcaaataatactttatttcaattataaaacttatagtgaactataagtcaattagaaatattcgactatagcttcatcctatagccaaacagctttttttagtattataaaagtatgccatttttctttataatatttatattaaaataaaaggagaacaaaaatatgttgaagataaaatatgatattgttggttcttttttaagacctgaaaaaatcaaagaagcacgagcaaaatattttaatcaagagattgatctaaaaacacttagaaaaattgaagatgatgaaattgctaaacttgtcgataaacaagttgctcatggactaaaaattgtcactgatggcgagtttagaagaagatggtggcatttggactggttaaaagaatttaatggctttacaactcaacatcttgataaaacgagaaatggtgtaacaaatcacattgaattaggaatgatcaacggtaaaataacctatgataaagataaatatcatccagaaatcgaggcttgggactacttattcaacctagtaacaaaatatcctggaattgaggccaaaaaatgtatctctggaccaaatatgatcttagttgatcattttcttcaattaggtttaaaagaggtaccatattataatggtgatattgatgctcttatcgatgatattggaaaagcatttcaaattgcaattaaagatttatatgatcatggttgtcgttatttacaaattgatgatacatcatggacctatatgattgatgataatttccttttaaaagtaagctcacttggatacaaaaaagaagatattttagaatggtttagaaaagtatctacaaaagcattagaaaataaacctattgacatgaccattgctaaccatttttgtaaaggaaattttaaaggctatcctcttttttctggtttatatgatactgttgcccctatcatttgtcaaatcccatatgatggcttctttgtagaatatgatgatgagcgttcaggttcatttacaccatgggcacgattaaaaaatactaatgttacttttgtagctggcttaatttcaactaaaaatcctaaactagaaacatatgatgaaataaaaacacgttattttgaagcaaaaagaattattggtaaaaatattgcattatcacctcaatgtggcttcgcctctgttgaagagggaaactgtattgatgaaaaaactcaatgggcaaaaatagaccttttagtttcatgtcaggattttttataaatcttattagagaaacaattagtttctcttttttattttcttcattatataaaaaaacaattgacttagagtcaagtcgaggttgtattatatgaaaaacggaggaatatatatgtttaaatttattgaaccaaaaatacaattagataaaaaacggcaaatctttacaaataagcatctacgagctctaatcatccccttgatcattgaacaattattgatcttattagttgggatagctgatactctaatggttagttatgctggtgaagcagccgtatctggtgtctcactagtcaaccagttgaatacggtcttcattcttgtctttactgcattagcatctggtggtgccgttgttgccagccaatatatcggtaataaaaacaaggaaaatggagtgttagcagctagtcaattagttatgataacaacaataatttcagttattttattagtattatcggttatttttcgagaacaattactaacattattgtttggaaaagtcgctccagatgtaatggatgcctgcttaaaatatttagttatttctgctttttcttttcctgctttagcaatctataacagttgtgccggattgtttagaagtatgtctaaaacaagtgttatcatgtatgtatcaatcatcatgaatattattaatattattggtaatgctattggaatttttattcttcatgcaggtgttgcaggagtcgcatacccttcactaatttctcgagtcgttgcggctttaattttattaattatatcttttaatcagaaaaatattatttatattcgcattaaggatatttttaaatggaatgctcaaatgattaagcgtatcctaaatattgctattcccaacggtattgaaaatggcttatttcaattatctaaagttgctttaagtagtattgtcgcaatgtttggaactagccagattgctgcaaacggggttgcacaaagcttttggtcaatggccgctcttttttgtattgcaatgggaccagcttttatcactgttatcggtcaatgtatgggagccgatgataaagaagcggcggactattatatgaaaaaattattaagaatcacttatattggcgggatcatttggaatattgtatttttcctatttacccctatcattcttaaattgtatagtttatcgaacgaaacgattaaactaattattattttatgttttattcataacctatttaatgccttattatgccctatagcctcatcattatcaaatggccttagagcagctggtgacgtaaaatacacgatgtatacttcaattttttcaactgttgtgtgtcgtgtcatcttatcatttatttttggggtttggatgaaccttggtgtaattggaattgcattagcaatggttggcgattgggctattaaatctgctcttatcttagtacgttatttacaagggcaatggaaaagttttaaagtcatctaattatcttgactatttatttttaaacaaactgattatttttcatttttatctgtgctataattaaacagaggagtctagttataatgaaaaaaataataaaacctattcaaccaataaaaccaagcccaccaacaaaaaacaaaccaaaaaattcttcaattaaaaagccatctaaataaatggctttttattattataaaaattctctttttatttcagaagaaatatttttaattactttagatgtaaaaggattactgaaacctgagtcttttaatgcatctaagtaatcaacattgagagtgttttgagtcatattgcgatatgcatttaatgcatcttcacgattttttgtacctactaaccataattctaatgatgaaactgcactcgtagcataactaatataataaaacggcgtttcaaaatgatgatgaatatcgacccattcatactctaaaggataacccatatatttttgataaatttgaccatgtaaagtattcatttcttctaatgaaatatctggattttcaaaaacttttcgttgaaattcatcttctatgcatccttgtaagatgctatttaacatatcattaataacctttatctccattagttttgcatcactaccgtatatttcatcataatattcaaacatcaacagctcaaatgcttgtgaatgaatctcggcaatatcgagattattaccatcattccaagatgttcctcccatcaaataaaaattgtaataatgcccaaattcatgaaataaagttgaaggatctttgtagtctgaagtattaataaataaaaatggctcattcccaataattgtcgtatacccagcatggagcatatttgaatcgtcatcaatttggtaaaggtgatgtttttgcatataatcataagcatcttgcattgctttaggaaattcctgttttaatgctgtttttaaatatgaaaaaccagattcgactgtaatttcactagtatccaatttttgtaatttttcttgatattttgtatccatctttgctgctagtggtgccacatactctaaaactgcttcctcaaatttttctgcatcttctttactaaaatctcgacctaacaaatcataagcataatccgtataattttcatatcctaattttttcgcaatttcaactctaatactgactaattttttataaatcgttcctaactctttatttttttgttcataaatatcataatacccgtcaatatcttcttgtttattaaaatctaagtcatcaattgttttactctgcccattgatcatcgtagtatattctttagcagcagttttactgtattcattaatcagcgctgtttcttgttcacttagttcctcaatttctggagaattgagtttcttattcttctcataacgttcgataaaatcttctcccatctttttaacaaacgcatctttatatgaagttgtcaaaatagcttcggttaattcgttcatacgattatctagtttcacaaaagcactagtaagaaattggtattcttcttcataataagagtctgacaaatcaatattattttttatagatgctaatgactccatttgatcaacctcttttaaatcatttaatatttcatcatatccttttaaaatttcttcttgatttccttctagcactaccttcgctaataaatcatttattttttgatttattgcatcaatatctggtctctcatagctcatatcttcaaaatttaaatcagaatgttcaggaacaacctcagcttgtggttgcggaatattataaccatctgtagtacatccagttaaccccaacataaaaaccaataaacatgtcaataatctatacttctttttcatctttatcctccttatctatctttaataattttttagttatatacaataaaatataaagtattaccctaatttttaacaaaatattcttttgtaaacattactaataaatcttttcatataataaaaaaacgtaaaatgcgatagttataataaacgattcaacgaataaacttaaagtaataatcaataaatatgtctttatcagagtaacaaaaaaattaatctactaaaaaaataaatgtatctaattaaatatagacaacaacccttttatttgaattaatgcatccatttttagagatactatcttttttacctttacagattattttaactgttgtgccatccattgccaaactctaattccacaacgatcagatactgcctcattattaaagaagtaaatccatgaccaatgaccactatatcgtaatggctctccatctttatcattaaaacgcccagaagtatcaataacatgctttgaaacaaaagtatgaacgttgctggccccagcccctaacaagcgcctaatcgttggcaattcatgggtttcaggggctacgacatcatcatctctggaataaataaagaatattggcaatttttttaattgtttaatttcttcatcagatattttttcatttaaaaaagcttcacaaattggcacataggcattatattctttaccatacttaagtgccatcaacattgtcatatagccaccatttgaacatcctgtgataataactttctcacttttagtttcttttcgataaaaattaatcaattcatgtaaagaatcacaataatatgaagtcccatctgcttccgtaaatttagttgctaaactatcaccagttttatccatccaaaaagttggacactgaggtaccagaatattagccccaccaatcgtattttggaactcttgacccgctaatgaactaaccttgttagctaatacagtaatataaggatcagtattaattgttcctccctcacctagcccatgtaaccaaacaaccaaagtatcacttgcttgcacaggattataagcagcatatttataactcactccatcacaagattcatataacgcttcttcaaacagatctgcactagtaatcttatctttcatttttttagcaatatttatttgtttaactttttgacctaatgaggtcatttcatgtccatcagctatcatgatgtccaattcatataaatcattatatgtattatattgtgtctgcattgaaaacaataatggatttccttctgctggactgattttcatttctatcataataaaattagatggttcactagttatttgaccactatagtctactaaataaacatttgttacagttctataaataatactttcaataatcggatatagcgtatcacaataatctgtagtcaacttcttctctttaaccacaaaactcagattattaacctgatcaattttatgatcgagacttagcaatattttattgacaccgcatccccagtcatcgcctttaataaaagctgtataacttccagatacaatcaaatcttttaaattattatttttactttccatacattttctccctttaataactcctttattataacatatttaagttattcatttagagtctttaaaataaaaatcctacataacgtaggactttttagtcaattaaaccatattttttcattgaattataaataccatcatctttaatatcgtctgtcacttcatcagcaatttcttttaatgcctctttagcattacctaccgcaatcccatattgacaaaattccagcatatctgcatcatttaatccgtcaccaaaagcatatgtattttctttagggatacctaactcatcaatcaaagcattaatagctgaagctttgttaactccaggaaccgataactctccactgttatcaccaaaaataggaacagtgcaatgaattacattaaactcttgctcaaattctttttttattttttcaaaagggaaattatctttttccaaaaaacaaatcttattaacatcatcacgatgaagatcataaccttcttttaatgatccaataaaatgattaggagtttcagctttagttctacgtgcaactggatcattttccaaatccccatacattattctttctaatcgtggaattaaattcttacttgcatataatccaccattactttcaatgtaataatcaaattcattagcctcaaaataatcaacaacatggttgattgctgtgcgagaaacttgtttgtgatataacattcgatctccaatttcaacgaaaccaccaccagctccaataattccatcaaaaccaacatccatgatatgatcaaaaatctcagctttacttcttcccgtacacaaaaaacataaatttcctttagctcttgtcgcttggacagccttaacggtcgaagcaggaatatattcttgtgatggtcgaacatctactaaagttccatcaacatcaaaaaaaataattttctttgtcataataccctccaatatttttataattaatacgattatactattaattaaaatgtatttaactttttttctaaataaaaaaatttatgtctgaattatcataattaactatgaaaatatctaaattatactagatttactactaaaaatagttttatgaggacaagaaaagtttttcccatattcctccatcgattcaagatcaggattttctaaccattctctcaataacacaacaagccctaaaataaaaatatttaaagtttgtcgaacttcttgactacatgaatactcttttaataattgtaaaataataactttcttaatatcttgataaaaagaaaatgaaaaatcttgattcactaaaatcttatatgtttcataatcttttttaagatacttattacctcattgagtaatagatctattttatcatttaatcctcgtcctttattttttcagtaaagctgcttggttgagccaaaaattctttttgaaagctttccgacaaatctattgtattttaataatgtgcataaaaagtcctacaactaatactagcacttttaatattatcagtgactataatcttacgtgtaggtttcttcttcaataattcaataagcacctctttgttcaaagctttagatcttagggtatttctatattttattggcataattactcctcccaattttatacaatgattacaaatttatctatgattaaataaatctaaagatattgaatattgttgttttattttcttaacagtatagtataaatatacagttaagataagcattttataaaaaagtagaggaatgcttatgccaaattggaaacttataaattattgatcataaaatctttctcttacagtctttaaaaaatatatactaatcataacataaatttagctgataatgatttaaaaattattcttgatattattaagaacaacctttattctattcttaatgaaacgtatttcccaattatattttttaaagacacatgaaagaatatctaactattttaaactcttaatagcaaagcattaactgattcaaaaaatttcaaaggcgtattcttagaatatgcctaaacctttttatatgttaattctccggcccattcaaaaccttttttttttgcaaatattacaccaatcaattcattaatcactgcggcagtagcaatcgttctttgaataatctaagcagctggagttgaaacagcaattccagtaaatactaaagatactcaagaatgtggtaatagtgtaaaaccaagatatttaatgactgtagcaggacacctaatcaaagttacccctaatcgtgcaattcataatattggattaaactcatgcattagtgaagatagttcagactcactaaacatatttgcaaaaacagctgaaagtatcattccaatcaatataaaattaagaattggttttggtaaaaaatagtcattaatgatcattcctaaaactgtagctataataattgttttcaccttaaataaacattatctattttttagatcaattggcatcaaaaactatatccatcttattcttaattcttaaaaatatcataattgaccctaatgaatgactgattaaaataacttttccaatgcttttacaatgacttggtgatcttcatgaggtcttaatccagtaacagtaattgcccctgctggtactccttttataaatataggaaaacttcccccacaaagaccatattcttcatcaaaaatcatttgattataattatgggtatctatattatcaagaaaaataaaatacgaggaatgttttgtttcaagacatacccgctctttacggcctaaccatttaatacttttttcattataactattaacaaaacatcgcctgattattttattgttataaactattcttgcagcaaatggtcgattataatatttagcttcatcaattattttatccataatcaaagcagcagtctggagattaaaatattcaaaaatatatttatattcttcttttaaaatatctagtttatttggatgatttcctttatttacaaaatagttataataattttccattttattcctcctgataagaaatctaattaattatattgttgaacccatttgataagcttcatcataacttgggtgtgtgtaagcatcacctttattaaatgctcctaaaccataaataattcctccttcatccacctttttgagcaccttaataaaccctctaaagctttcaattgttccgtgcatttgttcacgatcagtacttccacttgttaaaattaaataagctgtttttcgtttagggctatttctgatttcatattcacgtgcaaacatacgatcaattaaaattttaagctgtgcactcagactataaaaataaactggtgttgccattacaaatacatcagcattaacaatttcctcaattaccttattcgcatcatcttttaaaacacacctattgtgatgtcctcgacagtattcacaagctaggcatggagcaattctataatttgctaaattgatttttattactttgtgtcccacgctcgtcgcacctttgataaattgatcagctaaaatttcactattaccattttttctaggacttgatgatataacgactatctttttcatataggcttcctctttcattttttattaattttctttttattatcatagcccttcaactttactttaagtcaaggggtttattaagtctaaaataaaagattatggataagttcataatcttttatttctattaattatctaaaaccatattgattgtgtggcacatatggttcttccaaatatgctatctcatctggagtcaggacgatatctagtgcttgtaaagcatcttctaaatatttaattttagagctacctactaacggcgatgtaatatatggcttacttaaaacccatgctaaagcaatttgactagttggtttttgatattttttagctaattcataaactcttttaatgatttcacgatcatgagctaattgataatcattttgcagtttaccacagccatctgtccgcggagtatcaaccgccttattaaagacaccgtgagcaagtggtgaaaatggtgtaagagcaatattttcgtattgacacattggaatcatttctttttcttcttcacgatacactaaattatacatattctgcatactaataaattttgcccatccattcttttctgcaatactattagctttcacaaactgccaagcatacatcgcactagctccaatataacgaattttccccattcttactaaatcattcaacgcttccattgtttcttcgatcggagtagtataatcccagcgatgaataatatacagatcgatataatccgtctgtaatctctttagcgaattttcaacttctgtaaaaacagctttacgtgataatccttttgcattaacaccatcaaacattgggtaatacaatttagttgcaattacaacatcttctcgattagcataatcttttaatgcttgtccaagaatttcttcgctcgcaccaagactataataattagctgtgtcaaaaaagttaataccatgttctagcgcatatttaataatttctcgagcttctttttctgcagtttttccagggattcccccacgatctaattcaccaaatcccatacatcctaaacatattttagaaacttttaatcctgtttttcctaaatttacatattccatacttttctccttaaattaacttttattttttggttttagtggtccataaaaatatgcagtagtagccccaccgtcaattaaaaaatctgcacctgtaataaatgctccttggggtcccatcaatagttctgctacatttgcaacttcatcagccgttccaggccgcccagctggacactttgcaaacatatttttataaaaatctcctcttggaccattaaattcatcaatagccaatggagttacaataattccaggtgagatggcatttatccgagcacccttttgtccccatttaattgcctcagccattactcttttttcattacagcgtttagcaagctgatacgcatgaagtgtatcttgaatattatgtggctgcagtacttctaagtccaataatttattcgtttctgtaatagccagcatttcatcaatttcaactcctaaagctggcattcgatgacctgactgacttgaaatcgtcaccccaactccaccgtcttttattactttacctatttcttctaataaaactgcagttccatataaatcaacttttaaaattgtttcaatcgatgcttgactaggtgaaactcctgctccattaacaagcatactaatttccccataattttgagcaaccttaatcatctttaaaatagactttctagatgataagtccatttcaactggtattacatcaaagccagcatcattcattatctttgtaatcctattagcattatcaatatttttatcaccaataataatttttttaccatatccaagtcttcttgcaatagccatactaatctgaccagcaccggttacgatcataacttccttattcacttttcctacctcctcattatttgtatggaatcccatatactttttaaattattttattacttcattaatacaacgtaaagcatttaaacttcttggatatccaagaaaaggaattcctctagaaatcacctttattaaaaaagctctatcgttccctaatctaatatttgcttcaatatgtgataccaactgtggctcacaccctccttgtgctgctaaaaagcaaaatgtaatcatttcacgctgtttgtaatctaagccttttctagtataataatctccaaaacaattatctgttaaccaataattgatgtgttttatatctgctgttccacttttataaaattcacacatatcctgaccaaaaatatcaacctgtgcttgtattcctttttctaaacgattgctttgattagtcgtagattgtccttgtaaaggtaaagtaataccatttttagtacaaaaatcgttaactacgtgtaaaaaaggaaatactctcccaatccctaaataagctgttgcttgataaataatttctttcatttcaattggtgttacaccaaaattatacgcagcagtcagcatcgctttaaattcatcaataccttggcagcctagaagcattgctaaaattgcaatcatacttgttttatcatctaaatcattttgattaactacttcgtcaaatgctaaattatcaaataattcaataaattctggatctgtttttaataattttgactcatagcctggaaacattcgttcatgatagttttgagcatttttagttattgccatatttcaattctcctttaaccacttaaatattttttcgtcactgtcaaatacttgactaccaaaaatatccaatccctgatgaattattgcattaggacaaattttatttaaatcactaatacttttacctaacccacttccttcatgagtacaaaatggatatatgtgtttattggtgaaatcgtaactttctaaaaaagtccaaagacacatcggcatcgttgaccaccaatttggatagccaagataaatattttcatattcctcaaaatgactaataatatttattatttttggtcttgcattagtctctaattcatctttagctaattttgtacactcatcatatttagacggatattcatgaagaggatgaatttcaaataattctgctcctattatagcttgaacttttttagcaatcacttccgtattccctatttttaaatctttaatagcacctgctacataattttctttccgatgcgaaaagtatacaatcaaactttttttcatcttactcaccctttcttttacagttatattttaaaatattaataaaactataacaattttaattgctaatcattctcataagtaaaacttatatgaaaaaagaactccaaagagttctaaaaatataataagccatatttaatcattatttaataaattacgtagtaattcagcaaattcttcaatataataattagtcttttccttatgccaaaaggcacaataattacgttgtaatggcttgtgatggtgataaagtggaattcgtgtaattccagtcgcaggtggtggtaatgttccaactgcttcaattggcataaatcctcgattacttacaaccattaaacgtccctcttctaaagtatcagcaaataaaaattgattagcaaaaccaagtgtattttgataaaaatctttttcaacctcttgttgttctttagttgaaattaaaatacaggtatttctctttaaatcagtaattgttagaatatcccgctgacttaatggatgccgacttgaaatctcaatataacaatcactatacaataactcataattgtaataatcatcattaaatgctcgtcgttgatcactgattaccaaatcaacttgtccagagcgtaaaagatcatataactcctcatgagttccattaacaattgatagtgatacctcagaatatgttttgctaaatttagcgattgcatgatgtaattcttgagctccataacatcttaaatatcctatctttaaagataactcctgatcttgtccgcgacgtacagtttctctctttaaattatctatttcgcttaccagctccactccatgacgataaaaatactcaccagcaggagtcaaggtaaattgtcgattattacgtttgatcaaatcaacacctaattcctgctctaatgctttaatttgttgggaaattgcagattgagatatataacattgttcagctgcttctgtaaaactattacactcgactacactaataaaatatttcatttgtttcaacaacatatattatcctcccaaaaaacttgtataaaaattatatcatattttttacaattaaagctagcttaagctttcgccattacttttaattactttttaataccaataaaatgactctttacagcttctttttaatgttcctttaccattatcatcaataatttctctaacttttccatatattctccttattttttttgaaatacgtatttcattctatcgacaattatcattatagagattaaaaaatattgatttaataaatatttttgtttttttatattttttatcacttgattattatacttttcaataaatacaaaaataaaagagtttcttgttaaggaaactcttttaaatcctattcacttcttaaagctgttacaggatcttctaatgctgctttcttagacggaattaaaccacctagcaaagtcaacaagacacttaatacaattagaataattgctcccatgattggtaatgttgcactaacactagtattaccagctatttcatgaattaatgcattccccggaataagtagaatcaaagttatccctattcctaatactccagctagtaatccaataataaaagtttctgcattaaagacttgtgaaatatttttcttagaagcaccaatcgctcttaaaattccaatttctttttttcgctctagaacactaatataagtgataactcctatcataatagaagatactactaatgaaatagcgacaaaagcaattaatacataactaatcacatttataatatctgtaactgaagacattaatgtcccaacataatcagtatatgaaattactttatcctcatcaatctttttaatattttcattataactatctaaaatattgattacttcctgtttcgtttcaaaatccttaggataaatatttattgcactaggcttatcaaaatcagcatatcctagatttttaagattcccctcatatgaagaagactcagtggtcattaatgacatcattaattctgagagctcttcttcattcatattcatttttatcgcttgggcaaaaacacttgtatcaatctttatcgcatcttgcatactattggcaagatttcccatttgcttagttatttgtgtacttatttgttgttgtaatgatttagtgatcgtttcggtatattgagtcattactgtttgcatttgcctttccaactgagcttgaaactgttcagttgccccacttgactggagaagtttgatcatctcatcctgcattaatttttgagcctgatcagtttgtaaaaatgccataaagtattcattcattttagttggatcgattaatccattatcttttaaatattgttgaaactgtgtcataactgcctgcgtaaaactctcaatattctctttaggaatatcgactttcatattagcaaaaatgttatccatattaatactcggtaaagaagctgaatccagtttaatctgacttaaatctaaatctcccatatcaaaagaaagtttattttgatcaaatgaaaaagctttcttcatcatctctccatcgacagtaaataaagagttcatatctaattgattgctatttttatcactgaattcttttcctgtaaaaacatcaatattaggattacttatttgtttattaacaatctcacttgaagctgcctgctcaattacatgattagttaacgctgcaggatatccaattccagattgtaacatcgttgcgctggcagaatctttaggctgtacaattccaacgattttaatattctcgccattttgaatcagatttttcatataattttcatcatcagttttatctttataaacattatatttactatcatattgataataatctgaggcattaacaagtttaaactctattcctaaaatatctttataagaatatgacttaatatctgtaggcacattaacggtttcttcttttgaaaactgttcaatcattttatcaagttctgaataatcacgtaagcctaaagtataaagcataaaatcgttaatatttccatttttagttaacactagaacacattcattataattctttggccaatttccagctttaatatcatattgatcttcataaagacttgtattacttggcatttgataaaatacatccgtactcatcatcgaagacattaggctatttgaattggctgatgagcctagtcctaatgatgaaaatgacttatcaggatttacttgacgaattaaatcagtattagtactgtaaatttgtggcgcaacattataagtatattcaattgaattagtattctctttgatattactttttccactatcaagatacttctttaatgaagtcaaatcattagaacctattttcgagaacatatttgtaatcatttgtgatacatgtattttagtatcatctttttcctcattattctgattaggctgtgtatcagtcatcattgacgttatatcaaaacctgtactttgaatctgtaatggatactctgaaagagtttcttcttcaattgactgtatatattgattaaccccatttgaaagtgaaagaattaaggcaattccaataattccaattgaacctgcaaatgaagttaaaatcgttcgtgccttttttgtacgaagattgttaaaacttaacaacagtgatgttaaaaaagacattgatgatttccccatattttcatgtcttggaacttctagtttatctgaactaacttcataaggattagaatcactgcgaatgattccatctcgtaattctacaattctagttgcataagcttcggctagttcaggattatgagtaaccataactaccaaacgatcccgggcaacttctttgagtaattccattacttgaacactggtttcactatcaagcgcccctgttggttcatctgctaaaagtatatccggatcatttactaatgctcgagcaatcgcgactcgctgcatttgtcccccagacatctgattaggtcgtttatgaagatgttctccgagtccaacttcctttaaagcatcaattgctcgtttacgtcgctcattcttggaaattcctgaaattgttaatgctaattcaacattagctaaaactgtttgatggggaattaggttataactttgaaaaacaaagccaattgtatgattacgatatgaatcccaatcacgatctttatatcgctttgttgaaataccattaataattaaatctccactgtcataacgatctaaaccgccaattatatttaaaagtgttgtttttccagaaccactaggtccaagaattgcaacaaattcattatcacgaagatttaacgaaataccatttaatgctatttgatgtaaatctccagtaatatattccttagttatcttctgtatttgaagcatatgattttctcctttttcaataataagtaaattctactcctcttaaataaactgaagattaacaaaaatattttcaataaaaagtttatatcaacataattactaaagttaattaaaagaaaaaagaatccaaataaattaatcctaaatcattaatactatatatttctataattataccacttagagtcgttataaagttaaagaaataatattttttctttaacatatattaaaaatactattgtcattccaatttaatttattttataaaaaaagatcatatcttaatgatataatctttattgataatatttttgataataacgaatccgcaaaatatcaaaaatcatcataatttgataattaaattgcaaaccatcaaatttaccaagaatatgcgcaaaataatcagcacaaacattctcataatcacgatatgccagattttgtgtaattagaaccaaataagcatcacaaatattttgtggctttaatttttttacatttctttccatcattctaccagttgctgtaataaagaagacaacatcgtcatcactaaacttaaaattcaaatcaaaatgatgatactcaacaacttcttttcccaatgaaattaaatctgtctggaaatcaactgctacactacttggatatagcgctccaagaataacaattctctgcttattaaaaatcaattcacaaagttcatcaatccactgtataaattcttccttagaataatcagtatttacatgctcaaggaaatcatttatatcagtgtttaacatccgcgcatgaatttgttcaagacgtccctgatgatcggctaaaagacgttctttaaattcatcaaaactatgtattccaaaatgttgacaaaagtccaagagttcttcttgactgcattttgctgcatcaataaatgataccataatatgattttctatcaatgtataatttttaattataaaattaccaatcctatacatatgatcatcatctaaacacccatttaaatattttaaaatccgtgaaatcattaattccattattattcctacctccttttatcaaacattaaataatccattacctatattatataataattaagttaaaaattaaattaatacatcttttctaactaatttttttgcctttatagcctatcttcttaaccatgccatcattgctcaattgataatctaaacgattaataattaataacaaatacgactttaatattaaagaaactcactataatatacagtgagtcataaatattcaaaatttagtctttataaaaatacttcctgcacacgagaaacaatattattacaattatattgtgcaaaatcaacaggattcattattaaaaaacgtttgtgatacttcgctgccatacttttagtatagtgttgaacttgtggtgccatcaacactaaatcatattctttcgatagcgtatcatcatcatagatactagtggctgaaaaatggtatggtaaatgattattattactaaaatcttgtaacatttgagcaaacattgctgttgttaacccactagaacaacacagtaaaatatttcgttcaccatcatcttcactcacttcatactctttctggcaaacacaaaacattcttcgcttaaaacttttaattaattctttaatctgattacgatcttccatctcataatgaagataaaaaatttgttcattatttgtacaatcaatgatgatttcttctacaaccgaattattccatacgacaatttgtccaaaaagattatctttaagataattatatgtctctttttgatcatcctctttgatacaaaattcagttcccggctgttcttcgtgtaaagtggatagccatgctttaaattcatcagtattaaaatttcttctacaacatcccatttttagccctcctatctacttatatctataaataaataatatcatcatcaaactaaactttcaatttagttaatttaatttcgaatcttaaaagtattcccagcccacttaagtactaaaatacaagcaatgacacaatagccaatacaaaatagaatacaaacaattccaaaggaaagaattggtaactcaagtttagtaaaagcataacaaataatataggtcaatgaaataattgttgaataaataggactttttacttcagtatgcgcattatatggctgcaataaataatataagattaaatagtgtgttgaaaaaaatatgctcattgaaattattgagataaaagatataaatgccagaaatgcttgatcaattcctccacaaataaataaaatagccatatatcctaatgctaaaacaactgctggcaataaattgattttaactatttctcttaaacgaattttaaataatattaaaatatttttaggaattcgataaaaagaataagtcaacattgaatgatcgcagtttacaaacattgcttgtgtaatatttttagcagtatttaataaatacataataaaaacaaaaaaaggtaaaatacttgtcatagcattatttgcatctttttgagtttcaacatcataaaataagataccaattatcacaactattataaatgcaatcatataagtttgtcgtttagctgttttccataaaattttcttatgtctttgcataaataattcattaaaatactcaaaaccagttttattacttttagtatcagcctctaaagtaatcattttatgatatgaatcattaataatatcttgagtatctgtatttaataacgaatcgatattttttaataatttatgactaagctgatgataatcatcatactttaatacataactcatcaaaataaccgctaatatactaaggattattaaaacaatcagcatcatcttaatcggaataatcagattagaaaaaataagtgcataacccactaataaacatccgatactaaatccaattattgctggtgaattattattttcacttcgtacctttcgattccttttaaaatctttaagataagcactaacagccattagctttaaaccaataataaataacggtaatatataacttaaccaaaaagggtattgtaatgtaaaagataaaatcatgaatgctgtcatatatccaacataatgtcggaacagagtatataagtattgtgatagtacaaactctcgtccatccattttcattaaaataactgcataatatttatctttcgagggatcaaacattcctgtattaaaaaatgctccgcctaaacttagaaaaaataataattgtaacattgcacgaaagttaaatacattcataaaattcaaaggtattatgaacataattgcaaaatatattatttttcctaaaaaaactgatataatttcccaaatagtatttaagatagtaacaaatatttttagactttgatttttataaagtgacataggtaacactcttctaataattggaatttgtttaaacatataaataatgctattaacacgataagtatttttcaaacgaaatgaaattagaaaggtatcaagcatgatcttcatcctttaaaatcttgattatcttttcttgaaaagcatcatcatccagatcctctttattaattaatgataattgtcctttattaaggataactatctcgtcacataaatcaactgccaactccattatatgagttgaaaaaataataatatgctctttttttatactttttaaaagctttttcatctcatctgcaacaacaacatctaatgatgttaacggctcatctaacaatagaacatcagggtgtgcaatgaactgaatcaacatctgcatcttatttttcattccgtgtgaaaaatcttttaataaacgatcacgatcttcttccaataaattaaccatatcaaaatattgatcaatagtttttaaattttttatattcttaatattgatctcaataaaaaactttaaaaattctcgtgccgttagaaattccggtactgttggagttgataaaacataaccaatatcactcatcgttaatggcttacggccattatcttcaagataaaaatcgcctttatctatttctaaatcttggttcaaacaattaaacaaagttgttttgccagctccattacgacctaataaaccatagatttttcctttctcaaagcaaaaactgatatcttctaaaacttttttatcttcaaaattcttttgtagatgttcaataattagtttcataacttccctccctatttttactaagtatatcatcgttaaactgtcatcacaataataagcataataaaacaccttcatgcactttacaaaatattatttataaaataaaaaccacgcctaaaagacgtggttttctctgaggctataagcctatgttgcttgctcgcgtctcaaggcgcttaaaaactttagatcgttatcgtaaagattcattctattggtacaaaaaagttattgccactaatggtgatgatttatcagattaatttaatcttaaaaagtcttctatagaaatctatagaaggcttttttgctaataaatatagtattataacaacatgttttctatttaatttaagtaaatttgctaatctacaatcttttcaaataccgggtcataactaactaattaattattgtttcaccttcttgttgcaattattttaacgcttcaatcacaatttatctattattctgatcaactgcctaagcctgctcacccaccaagatttcttcctctgaacatttaatatccttatatccttgtagtgtttgtttatataaagccatttttatttttccttctcatttcctttttcatattctaaagctaattttaaatcatattccattattttattttctattaaggcaaaactttgaaaaagcaactaatcatttccacttttctagcgaatagcttaatttttttatcaaataaaataatattcccacttgttaatgaattcaatcattcctttaaaataggattcggatagatatatttaatgctgataatacagcaataaaaaaacaatccctctttatctatatctgaataatgagataaaaagcaagaaaaataacttttatttaatgaagacatcatgtttttaatactaaaattattattcctatataataataaaagaatcggctgtaaccaattcttttattctacatcttcttcatatttaataatttcaccagtatctgcattaatttctaattcatattccttattaccatttttaatctctatctcatattttttaattccatcatcgtcatcataatctaactctgtttttattaagtaaccaccaccaacacgatcaaaagcgattttttgagcttcctctaaagaaacagccgtattaacaggagtaatcggagtaactgttccatcaactggattggttgtcgtacctatataatcatcatctttttcccgttttaatacctttccactatttgcgtctacttctatttcatacttttctgtatcagttataatagtaaaatcatagtaagttaccccatcatctttatcttctttagccttaaggatttttccttctacttcttttaaagcaatttcttgtgcttcttccaatgttagggcactaactttttcagtacatccaactaaagctattgtaattaatacaaataaaattattttcttcataaatattatctcctttcaaaatcaattgtaaaaattgtatattgatcaactatactttcaaccgtaattgcatagtcataatagctgcaaattcttttagcaattgctaaacctagtccaaaattgttattattttgagcccgtgactcatcagcccgataaaagcgattaaatatatagtctaatttatctgcttctatcccaatcccgtgatctttaaccattaatttttggtcaacatataataattcaattttcttttcttcttctcttgaatatttaattgcattatcaattaaaataattaaaagttgttttaaatgttctatgcgcatccatatctttgaagttacagttattttaataataaattcaaattctgggtgaacttctttaaaatttgtaattacttcatcaactactaaattaagatcagttggttcttcacaatgaatatccatttctcgggttaaatgaagaagttcattacacaattggattaatcgctcaacttcattactagtgacattaagtgaattgctaagaatagcaggatcatcttttccccaccgctccaacatatctaaatttccttttataattgccaatggcgtttttaattcatgtgatgcatcacttacaaattgattttgttgtaataatgatctttccgcttgatcgattgtttcattaaattccttgcctaataaagctaattcatcatttccctcaataacaagccggtgacttaagccctcatttttaatttgtttaatactctttgtaaattgatcaacagtttgtaaaaaacgtttactaatcatgaaaccacaggcaatactggtaatcaatgcaacaataattaaaatcaaaaagattacagcaacaatactagctatgggggttatcaaatcttcatccattgcatagattcgtccaataatcaataaataataacccatataaagtaataaaatcaagctaaatactacgatcactgtcataataataattgaagtagtactaactaattgatgtcgtagtgatttaattttcatgataaacggtatcctactccacgtactgtttcaattttaattccgggaattttattacgtaaataacggatatatacttcaacaacatttgttgatacatcttcatcataaccccaaacctgatctaaaatcttattgcgactaacaacatcaccgccattttgaactaataatgataataaatcaaactcagtcgttgttaaatttacttcattatctttgaaaaagaccttgtgcttacttggatcaattttaacttctccataactatattcaagaagtgctttttgaaagttcattcttctcaatagtgcatttatcctcgctaataattcttccattgcaaacggctttgctaaataatcatctgctccaacttgtaaaccattgaccttatccatcacctcatcacgagctgtaagcataattactggcgtttgtttaatctctcgcaagcgtcgacatacttcgattccattaattcgcggtaacattaaatctaataagattaattcatattcttgctctaaagctttttttaacccaacttcaccatcataagcttgatcacaacaataacctgcatgggttaattctagctttaatagatctgacatatttttttcatcttcaattatcagtattgccatcttcatcactccttatattcaaatccaattatctttccactttttgcactaatatttatctcaatcagttcttgctgctgattctctatttcaagatggtaaaatatttgcatatgctcatattcaatttgtgaagatacgatagttcctggaaattgtttcaatgctacaacatgtgcttcacttttagaataattaatgttatttaaagttgtatgtaatatatagacaccaaaacaaataacactaatgacgattattattgtagttgttataatttgttttttataaataatcagcttttccattcccatcttcctttcatctatatcataacctattttgcccgattgttgcttaaagaacaataataattaaataagaattttctcattttctaaaaataaataagtgtgatctaaaatcacacttactcaaacaaagcaaattctaaataataaactagatcatgaaacattctagtattaaagccataacagctgcaatcatctatttctccatcccaatcattatttaatcgttctaataacagcggtacctctgtaacatctaaattagctgttacaaaaaactcactacaatctttttttccagcatactcacgactcggtgaaattgaaaaattaggatttatttgtaacaacaaatctttaatcatttgataatcttttatatcttcactttcaataattacatataatctcgctaacataaaaccacctctttcctgcctattttatcataaaatattgtttagataaaagtatgctattaattaattttattctgattatatttactaataaatatgttaagataaagtaaagagatatatttgaaagctgggataattatggatgaatcactaattacgatcattgggtttattattggaggcctatctatctttatttatggaatcaatcttatgagcgatggcctcaaaagtattgcaggatatcatatccgtgagtatattgaaaaatatacaagtaatctttttacctcaattttagtgggtactttaatttctgcaatcctccattctagttctgctgttacagttatttcaatcagtctggttcgggccggattaatgaagttggaacaggctataggaatcacgattggagcgaatattgggacttgtgtgacttcaataatgataggcttgaatgtggaacaatttgctcactatcttgtctttattggggttgtaatcatgtttttagctaaaaaaaagacgattggatacatcggcaaagttgttctgggctttggactaatttttgttggtctacaaataatgagtgatcaaatgatagcctttgctaaagaaccttggtttacaagtatcatgacaacgttaggaaaaaaaccatggtgggcacttctaggtggaactatagcaacaggcatcatgcaatcatctactgctgttatcggtgtagtccaaaaactttttacaactggttcaatcactcctgctgctggtgctgcatttatttttggggccaacattggtacttgtattactgcggttattgccgctttaggcggatctatttcaactaaacgagctgcctggtttcatgttgtttataatctagcaggtgcaataataggaatgctcgttttaaaaccattcgttaatttaactaattgggtcaatttgctgctaaacggcagtcaagaaatgtatattgctcaagcacacttcatttttaatatagcttcaactattttagttattccttttgttcgctattgtgttattttattagaaaagttaattcctgggaatgatcatcatgatacgctcattgaaaatatcgatgagctagatgatactttaattgacaaacttcctgtcggagcattagcagttgctaaaaagaatacactccgaatgggacgaaatgttatagccaatattaaattatcttatacttatttaatctctaaaaatagtgaagattatgatgaaattatcgaaattgaagcactaatagataaatatgattctcgtttatccaaatacttgctaaaaattgctcaacagcccacattagcaaaaaagcaaactaatgaatactttaaaaattatcaaattatcaaaaatcttgaacgaattggtgacattgttagtaatttagctaattattacaaacttgtttacgatgaaaaaggtaaattttctaacgaagcaatcgatgatttaaataaaatgtataaattagctttagaaatggtccaagatgctctagatatttatgaacacgataatgcaaataaacttctttcttctttttgataaaaaacagatactaaattaagaaaaaccgcataaatacagtgtttatcagcaaaatagcaagagggaaataaggaaatttacaacgaaattacaacaaatgaaagagccctatgtaacgacttataaagagaaatacagagttataagaaatcgacgcttgaaacagagcgtccttttctatgtcgtgaaacagcatactatatcatttctgcttgattatcttaagacttattagactatggtttgtcaagagcttgttgcgtatgcaatgcgttagcactctttacaaccataggctgataagtaatctgttcataagcagaaataatatagaattatcaatgctcgatactatggaatatcaaaaaataattctttgacaaaatttaataaaatcgtaccattaaatatggtataataactcgaggaaatagggaggtaataaattaaaatgaataaaattagtataagattaacaagttttttgttggcaatttttagttatgttttaatttttcaaaatatagtatccaatcaagaacaaataccacttaataccaatgaacagtttgaaataaatattgcaaatacattgataactaaagaagaattggcattagaattggataaaatagttgatactaataatgcaacactgattaaaatagcaacaccaactaatgattatgaaaataaaaaagatattatttactttggtagtaagaaacctattagtaatgatttagttgttacaggcaataaaataaattggcttgacgcaaaattgacaggggaattgatttcatcaaaaaatataggaagtcgtccattatatggaacatacgcaacagataacaatgcagattttaaacatgacattgaacaatgggcgatagaaaatggtattgatattgaatggacggctactccctcactgctaaaagatatttattataatttggtgcataacggagtaggaaacgtaattttgacggcatttttattatttatttcttctatgattgcgtggtttgttttaagagcaaaggggcgtagtattagattattgggcggagtagaattaaataaaatttacaaagaagatacgttggcaatatcaaaattatttataccaagttatattaccgcactttttatattcttactatatataggagtttcaagaggaattagacaaattccgttagttgttacaaatagtttaattatattagttgttctgacggttatatcattagtagtaacatatggaatgtcaattatagtgaagcctaaaagtgaacatatagcaaaaagaataataccactaaaaagattcaaacaattaagtgtaggcactagaattatatcaattatattagcacttttgatagtaccaagtaccattacatcagcttacgttcttcaacaattatctcatgaatattctttgtgggaaaatatgcaaagtaatgtaagtttatctttcggagatttagactcattagaaacagaaaagatgcgacaacatgtagagaagttttttaaaactatggaaaaaaataataatctctctttatctttagtaattgataaatctattgaattaaacaaagaggaatatggtggatacgaccatattattattacagatagaagttggataaactctttcaacataggaatagaaaaaaacggtaagggtggtaaattaacaaaaatagagttaaatgcgttagacaaaccgttacaagattttctaacggcacaaatgccattgtggacaaaaacacaagaagtacagcctaaaggagtagagttttacgaatttataggaaaaaattttttgggattacctcctaatgttggctctggtggaagtaccgttcaagctaccaatcctttgattattctaattgatagtccatcggaaatattagatattttaggctttactttgccagcttgttccagcggaaatgtcgtttttccaaatgaacaattattaagaaccgaattgaataaatcaccgataaaagagtttgttatatctatcgacactattgctgatgttgctttagcacaagctcaaaaatttgaaaaagaagcaatattctacattgtagcttgtatattgatttttatatctatggtttttgctggtattcttactgctcaattatgggtaaacgaaaataaaaaacgcatattcacattacatacatttgggaaatcatataaggaaatcattatgcctaattttataaaagaatgttgtgttgcaatacttacaatatttgtaggagcaataatttcgtttgttataaggcgaccggatattattacagtaattattgtaagtatagctattttaatcttgtatagtttaagcagtttcattgcatatcatatatgtactagacaagcattttatagagtagcgacaagaaatgactaaaaacataaagaacggagtaaaaaaatggaaataaaaataagtaatattagtgttaagattaatggaaacctaattttttcaaatttaagttatattatgaatagtggcgatatgatagctttaacaggtgcttcgggttgcggaaaaacgacattgctaaactgtttaggtttaatacaaccaattgagagtggaactattttaattgaccaaaagaatgccaccaaatggaatgataaagagaaaactaacttttggcataaatatgctacatttatttatcaagattatggtatcatcgaagatgaaagtgttgcttataatataacactggataaatctaaaatccgtaaatcagaagtggaaacaattttaaaaaaagtggggctaagcggtagagctaatgaacaagctgtagttttatctggcggagaaaagcaaagaataggtatagcaagagcaattttgaaaaacgcttctataatttatgctgatgagcctacggcttctcttgatagcgaaaatagacaaatagtaattaagttacttaaagaatgtgctttaaatggagcaatagtcattttagctacacatgatgatagattggtaaatgaatgtagtaaagttatagatatgtcaaggttatagttttacaggaaaaagctttctaccgacggagtgatccgccagcggtggcggtcgtaagacatatcgccacgccagcttgctggcgagcggacggttcacttcggcggttgggcgagcttgcgagccttacaaagcccccgttatctaacaggggggtactattacaagaaacaaggcacaaaacaattacaaaaatcccgatatgaaacgatgtacgaagttataagaacttactgcacttcacaccctgtcatttctacccgacaggtcgaaaacagcatatcggaagcaaaaaatacaaggtgtatgctcctatgggcgtatgccttttttgattggaggaatgaacatgaatgacatggaatttatcgaagcattgaaaacaaaacggaacgcctgcggttattcccaaagcagactggcaaaggaactgcacatcagcaggcaaaacctgaatgagattgagaacgggaaaacaagagccagcaaagaaatgaagcatacgctcctgcattatctggactactgcaaatgcacacagccttttacgctgaatattgattatctgcgtgtccgcttccctactacggacgcattggagattatcaaaaacgtgctagctatgaaagctgaatactttatccatgaagattacgggctgttcggctatgaagaactataccgctatggcgagattattgttaccgcttccaaagacgcttctatgggcgttttactggaattaaagggcatgggctgtcggcacttggaacacgtcctacaggcaaggaaaacaggctggtatcactttttgagccgttgtatggactatgagggtatctttaagcgtcttgacttggctgtcaatgatatgggcggactgctggatatagaaatcctaagagaacgctattacgccgataaggtatggaaacgctcaaggaaatatgagggcgtggacagtggaaaactgtcgggggcaaagggagataccgcaaagaccttttatatcggttcaaagaacagccctatctacttctgcctgtacgagaaagaaaaagagcagaggaacaaaggcatacagaccgacatcaagaaccgtcttgaaatccgactaaaaaatgaaaaggcaggacaggcggtggaagaacttattttttcaagaaatcccgaacagaccattgcaagccttgtcctcatgcaagtggactttcccgactatatcctgtgggatatattcattgagaatatgaccgcttccctcccgttcatcatgacacctgttgccgtcaacatggataagacgatacgctggctggaacggcaggtcatgccctctctgctgatgataaaggagattgaaaaggaaacgggggcgaactacttggaagcaatcgacaggcagacgagattgacagacaaacaggaattgaaaatcaagcaaatgacaaccgacatatccgatgtgattataggctgataccgctgtttctaaggaatagcggtatttttgattggaaaatattttcaagaaatttccgcaaacagtcattatttgggcggtcagcggacagatatgggatagaaagaagaaatcttgatttttttcgcttccagcttaacaaacagctacttgctggacagatatggtgtggaagaagaaagataaaaaaatttctggatttagtcattaaatcgcatgttgttgtccctatatggagtagaaagagaaatttcttttcaaaaatggaagcaaaacgccgtttcctgtccctatatgtagtgaaagggaaaaaagcaaagcatttttgcaacaaatcgtcttttagcggactgatatggagtgaaagaggaaaaaagtgaaatttttttatcaatcaacttagcaaacagcactttgctgtccctatatggtgtgaaaggaagaaagcaaagcgatttttgccaaaatgcacctttctatttgtattaatggtgtagaggagatttcttctttcaagcgttctttgataagtgaataaagcggtcagatacgttagacggacagcgagccgttggagcagacacgccacgaccttatttcctgccctgtaagcgagcgagaaatgtctgtgttcatagaaaaggcttgtccccttttccagtcatgacctgtcccgtctgataatgatactcccgtacagccacagcttgagcgttcagagcgtcgcacgcaatgggtacggctacatgagaaccatgcagaggtgcaatccctgtgggctttgacacaagccgtctgaccgcttcaaaactacgaggaaaggaggtgtcatatctatgcacgatttaagtatgccgttatgggaaagatacctcatgacgatagaggaagcgtccagttatttccgtatcggggagaacaagctccgccagcttgccaacgaatacaaagaggaatgtgttgtgatgaacggaaaccgtatgctcatcaagaaaaagaaatttgaaaaagtcatagaccgattggaacaaatctagtgaaaaagagccttgtgtgtgataagatgtgtataagtcgttacagcaaggctctttcttactttgaaaggagttaagaaagaatgtcatcagcaaaaagacgggataacagaaaccgtatcttatacagaggagagagccaaagacaagacggcaggtacacctataaatatgtggacgcactgggaaaaacaaagtatgtctacgcatggaagctgttgcctacggacaagacaccagcaggaaagcgtgaggacttgtcgctaagggaaaaagagcgtatcatacagcgtgatttatatgacggtatcgacacaaagggaagcaagatgaccttgtgccagctatacgccaaaaagaacgcccaacgaccgaacgtgaagaaaagcacccaacaggggcgtaaatacctcatggaagcgttggaacaggacaaactgggagcaaggagcatagacagcataaagccgtcagacgctaaggaatgggcggtcagaatgaaagagaacggtttttcctacaagacaatcaataactacaagcgttccctgaaagcgtcattccacatggcaatagaggacgattatgtaaggaagaacccttttaatttccagctaagcgaggtcatagaggacgacagcaagccgaaagtcgcattgagcgaggaacaggaagcaagattgttagacttcatggagcaggacagaacctatcagaagtatcatgatgatgtgcttatcctgctgaaaacaggcttgcgtatctcggagctgtgcggactgacaaggagcgatattgatttcaagaaccatgcaatccgtatcaatcatcagttacttagggacaaggacggtttctacatagcagagccaaagacaaagagcggtttccgcaacgtgcctatgagcgaggaaacagagaaagcctttaagagggtgctgaaaaggaagcagaagccgacactcaaggagatagacggctaccacaattttctgttcatcagccctagtggaaagcctatgcaggagagcaattataaatcggtactgaatggcgttgtaaagaagtataacaagagtcatgagaaaacgccgttgccgaggataacgccccacagcctaagacatacgttctgcacacagcttgcacagaagaacatgaacccgaagaatttacagtatatcatgggacatgcaagcataacgataacgctggacttatacgctcatgcgtcagaggcaggagcaaacagagaaatgcgaagccttgtagcatgatttacaacgatttatacaacgttttcgagtgaaaatataagggattacgaccagttccacggtagacctgcgagaagaaaaaaaccgtcaaacccttataaacagggatatattgacggttcgtgatagttataaaaagatactgaaaaatctatgctgtttttaaacaaaaaagaacatactttaaatgctttagaaattgagtgtcgtcaaaatcatctagtccgaatgcgtgacggtatttgtgaagataatatcgctgcttctatcatcattgatattatttctagtattgaacgaattggtgatattgctttaaatactgcaaattcaacaattacggtatacaaagatcataaagttaaatatttaaatgtttgatttttacataaaaaattactggaataacatccagtaattttaatttattgcatctttatcggtttcaccggttctaattcgcaaagcactttttagatcataactaattattttgccatctccaggattccccgtaaatgctgcggtttgaattgccttgattgtcttcttttcccaaacttcatcacttactataatttcaaatttaatttttggtaacatatttatttctacttcattacctctaattacttcacgatagcctttttgaattccacaccccataacttgataaactgtaatcccatgaacttcaattttagctaaagcttctttaacatcctcaaacttatcttcacgaacaaatgcttctattttaatcacaaatcactcctccttactctaatccattaaatgatgggtatgctgtctcattatgttcagacatatctaaccccatctgttcatcacgtttatcaactcgtaatggtgtaaatagccgtacaactcctatacaaattaaagtacctatcacagcaactactattgttagtaaaatgctaataatttgtgcaattaataagtttgtatctccgaagaataccccattccatctagctacatcattgattgaagtttgagcaaaaagccccgttgcaataccaccccagataccacctattccatgacatccaaatgcatctagagcatcatcatatccaaaatattgttttgctttagaaatcataaaatagcaaattgggctaccaacaaaaccaataataactgcagaccaaatcggaacaaatcctgcaccaggagtaattgctacaagcccgacaactaggccggttacacttcccactaaagttggtttattaattttccaaacatccatcaacatccatgataacattcctgaagcagcagcaacagcagttgtcataaaagcgtgtattgctaatccgtcagcttttaaagaacttccggcattaaaaccaaaccacccaaataatagaaggcttgcacctagtacaacaaacggaatattatgaatacgatatttcgcatgatcataatccttacgtttacccaagataatacacaatactagcgcgcttactccagaactaatatgaacaacatttccaccagcaaaatctactgaaccaatttcagccaagaatccccctaatccccagaccatgtgagccataggataataaacgattgttgaccagacaattataaaaataaacaacgctttaaacttcattcttcccgctacagcgccagtaattaaagctggtgtaataattgcaaacatcatttgaaatgctgcaaagcctaaatccggaatcgtactggcataattacctggcgtcgttcctacattactcaagcccaaaaagcttagatccccaattattcctagatgatcatttccaaacgccaaggaatatccaaataatatccacataaccattgctattccaattacaaaaattgaagtcatcatcgtattaaccacattttttcttctaaccattccgccatagaaaaaagctaatcctggtgtcatcaataacaccaatgctgtacagattatcataaatcctgtatctccagaatcaatcatatttcttccccctttatttatgattatattggaagtatagatgatatttttttattaagcaagatattttttatcactaattattttcagtttaccttgtcgtaaaaaaacattgatattatcatagttttttaatttgttaaaatattgttatttttatatatgataaaaatagttattggcatataagtttccaattaactcgttattgtatattagtgcagttattattaattcatttaagttagaaaactatagatcattacaagataaaattaaataattgtcatttttaaactgtttttccataaccaacatagaatgattcacaaaattatttttaaagtattcttttgaaattaaaatcactcctataaaagttatacctgtgactattaatcatatatataaatcatttggcacagctctaattagaactgctccaattacaaagtaaaacaatatatatataattagtatcttagataaaatacttaatccttttatctttctatttaaaataaactatataaaaatcatagcatatctattttataaaaaaggcataattttttcacaaaactaaaaagagctgtaacattctaaaatagtaaaaaaactactcactagttacggctacttctataagtatatctccttctttacttggctctatagctatcaatctattaacttttttgcacaagtgggacatgcaacataaaagtaagtacatccgttttcacatttataatctattattttaaaactactaacttcagtatcaatgctctctttagttactatctttttcattattttcccgtcaaaagagatataaaacaaaaactatatcacttttttatgccttacgttaatattaatcaaaaaataattatacgatattttgttctattacattaataatattgtatctattttttatcgtagcaagataaattttgtagtatattcttgttttcgtaattttcctaaaataatatatttgctaattattcaagaacttttctatatcttcataattagatatttctatattaaaaacatatgaaaaaaatttttgcaattcacatatatcatattctttaaaatttattttatgtatcttttgatacacttcttttactaaaaatcttaaatctgaaatataattacaacatactaaatcaacaacatctttaaaaatatctctatgcataataacctatcccctcaagctttattcacaaacattttaaatataaatactgaattaaaaaatacatcaatcaaataaaccaaaataactctccaaaatttcaatacaatatacaagtaaatacctttttaatatcatattaaatttttaataatattttttcccaaaaatatatcctatatcaataaaatttgggaacaatttaatcacataattatcatattatatagttgtaaaaactataaatagcttaagttctgttgtaggtggtgaattatgcttgactattttttagaaaacactacaaaaaagaaattatatcttttttccatcttatatttaaagagagtcacttctgtaaaagaatgtaagtatatacttacatttagcagtaccagtataatttcaataattaacgagttaaattttgatttcaatggaattgcagaaataaatataacaaattcattggaacttaaattaattgtatacgaagatattacattttctgatttactccatgctatataccaaagctctaatgtattgcattgtatcaagtttatgataaccaatgaatcaaaccattcttttttggtatttgcggaagataactatcttgcaaaatccagtgcatatcgaatacgacaaaaatgtattaaatatatccgcagtatcggtttggatattaaaaaaaataaagttataggggaagaatacagaattcgatttttgattgctcttttatactacaaatgcggtatagattgttgcgatattgatgaatattcaataaaacttattaaagaatttattatatctactaaccagtcaattacttttgaatttcttaataacgctacaaatgaatatgattattttgaatgtctaatgtcacttttgtggaaaagaaaagaccacaatgacaatttatctataccaaaggagcttgaaaaatttaaagagatttttatatacaatgatttgaaaaaatatttacataatgtaattgggaatcagcttaacatagatttttcaaaaaaagactatgattatatgtatttagtttatttttgtactaataactttctttttgccaaccagtggacagaggaacgtaaagagcacatttataaaatatttctttccaatcaaaaattttatgatttatatattcgtcttagtcataaatatggtaaatttctagaacaatctcacattttcaaaacaattttaatctatttttttaaggatcatctttttcaattacaatgcctaattccaaatcagcgtctatatatagatactacacctactacaacttacatcaccaataatgacgtatcaggtatcataaattcatggaaaaaggcaaataatatattatatccaacagataaaagaagtatattctatttaacaacacaaattgaatttatattaagacaacttgttccacctgtaacaatcatattgttatctgatttaatgtccgagatagaaatgataaatctttttcttgaaaaaaatttttcccgcaatcgaattaatataactccgttacttttaaacagttataatttagaatatctgaacgctgaaaaaaatagaataataatcattactcgaggaattgaatatttattaaaatcatacaatttctttcaaaataatactatagtaataatagattctagaacaaccttatacgagaaagaaaaaatttcgaatgctattgccaattatgaagaaaaacaatttctaaaaatttgtgctggaacaagtcttactgatacagaatattaatgatcaacataagtgcaacagtctatttatacaaatattatattatttaaatagcatattttatcttaaacttatttcttggcaaaaacacttaaatcaaaaaaggactgtaacgaataaaaattttaatctttgacatacccccttctaagtgacaattttttattatttcacttgtctacctagaaggaagcatatcatttaatccgttacagcccctttaatcatatactaattcatcttgatttataacctcttcatcagtaaaatatgcttgagtttgtactatgacctcttttcttaatccaattaaaccaattaaattagggatagccatacaaccattaacaatatctgcgagaataaaaataaattctaatgacataaaaggaccaattgcaataaagacaatataaataaatttataatatggaatcgcttttaaaccttttaaataatacatacatctctcaccataataattccaaccaattatagtagtaaatgcaaagaaaattaatccaatattaacaatatacttcccaatcataggaataaataaaccattactaaatgcttgtgtagtcattgcggcaccttctaaaccactagtatggctattagtaagtaaaattgcaattcctgtcatggtacaaataacaactgtatcaataaacgttccagtcattgataccaatccttgttctacacatgaatcagtttttgctgcagcagcggcaattggtgcacttccaagaccactttcatttgaaaaaattcctctactaattcctttttgcattgccattgtcatagtaatacctataccaccaccaagagctgcttgaggattaaatgcactatgaaccactaatacaactgtctgcgggattaagttaaaatgagtaattaaaataatcacaacaccaccgatgtaaagaatacacatcataggaattactttttctgctacattcgcaattcttttaatcccgccaattgtaataaaacctacagtgatcgttaataaaaccgctgtaacaattggtggaacattaaacgataactccattgcatcagaaattgatttaacttgagtaaatgttccaattcccaataacgccacagcaactccaaaaaaagcaaaaatcttagctaaccatttacttcctaaaccccgttctaaataatacattggtccccctgccatttgattattttcatctttgatacggtaacgaattgctaataagccttcagcatattttgtagccattccaaaaaaagctgatacccacatccaaaataatgctcctggtcctccggccgcaatcgcggtagctactccaacaatatttcctgtcccgatcgtagaagatagtgctgtacaaagagcctgaaaacttgatacatcaccttcatcattatcctgttttttaaaaatacatgaaaacgctaatttcaatttcgttaattgcaacagttttagcttgcatgtgaaataaattccagttcccaacaatagacaaataagcggtaagccccatacaagctcatcaatttttgtaagtaaatttgtaataaattgcataaaaaaactccttcttaaaataattaagtcggaattaataatgaaaaaaactattcatcccactgtccttttacctgagagtttcacctataaataggcttgctccttcggtgcttaatttaataagtctctccagaggttcgtccaatagcgatccttttacctgaaatctttaattcttcggtgttcaattagaatctctttcgccattatcatccgatatatacactaagattatacgctaattgtatacaattgcaaatattttttatttttgcaataaagtatttgtaaagacgacatttctcttctataataacaattatgaaaaaattaaaatattttattcctgccctaatttggatgatctttatttttataatgtcacacactaatggtaatgactcttcaaatcaaagtaattttattgctgaaataattttaaaagttattaatattgatcgtgatacattaacttttataattagaaaagccgctcatatgagtgaatatgcaatcttattactcttactttattatgcactaagtaacgttatatctaagcatactttatcattatcattattagtcacatttatttatgcttgtagtgatgaatttcatcaattgtttattccagggcgcagtggacaatttaaagatgttctaattgacacttctggtgccttgatcatgcttatgatcatctttttatggcaaagaaaaaagaagtctaaactaatcaaataactttacttaagttattttgattaatcattagacttcttttcattttgcagtttttcaatactttcttttaacttatcaatggcatcattaagtacatcaagatcattttgacgatcatcgttgtcatcatcactcggtggcgttgagcgttcttctaagacagctgaccaagaagagtttgaggctaaaatatcacctacaacattaaaccatgctcccaaagcagcctgctcactcgtagtaaaatcatttgtcaatagatatcctaagatcactgcagttccagtaaaactatacggatcaagattgggtatatacatggttcacctctcccatattttaatatatgctaaataaaaaaaaaacttaggcttttgcatatttaatatttcgctgcacacactattattgggtgaaaaaatgaatgataatgtaaaattattaaactttatttatcaaaactcgcaaatgggagttgaaacgattgagcaattagaaaaaatcgttgaagataaagactttaaaagatatttaaaagaaaaatatgaaggctattgtaaaatccataaagatgctaaagaaaagttaaatagtcatggatatgacgaaagaggaattggttcttttgaaaaaattcgtacttacttaatgatcaatatgcaaacactgaccgataaatcaactagtcatattgcagaaatgatgatgattggaagtacgatgggaatcatcaatgcaattcgtaatatagctgattacaatcatgctaaaaaagatattattaagctcatggaaacattaaaagctttcgaagaaaaatcatatggagatttgcaaaaatttatttaaattgctgttaatgcagtgctctcctaagttcaactttgtgagggcactacatatgaggtatattatttctaattaaaaacagtattacaaataatactgtttactatcactaattataatcaattaaactaaatttcttaaacactggtttttgcaatttcataaaaatccccatcattggaccaaataaaaacattccaataatagttccctctcgtactgctaaaggcacatcagtaataattacaattataattactaataaaattgaaactacgtcaaccccttgccgtaaaacatggaatttctttccagtaactccgctaacagccatacaagctccttccaaagcaaatgtaacaatatctagaaccattaccattcctactgcaaaagcactgacgatatatcccaaaattaataatccaacattcatccaatatgtattaatcgtaaaattactgtatacttcatacaacatgaagttaacaattagccctaataagatgcaaacaggaatttgtaatagctggatcggcttaaattttcttctaagtattgccacttgaacaaagatacataaaaaattacaaaacataccaattgttcctacctctatccctgtaactaaactccctgtctgtgccaaagcatcccatgcacctactccaatggccgctttcaaggttagagctgaactacatgcaacgaccacaacgccaaacaccaaaactattacccgcttaaacattttaattagtacctcgctttttttgtataggcattattatagcggtttcaataatctagtcaacctattttttaagcgttttcaaaaatagaaaaagggtaatctacccttttaaaataactctacttcttgtatgagtgcaattagctcgcttaagttattaattacataatcagcaccagcatctaaatatgcttctttaacccgttcaattgcacgattccgttctttaggtgttaaagcattaaattcttcttcgttcaatcccaaagttgaacttccctcaatgacaccaactgcgattacccctgcattaacgccttcttgaatatcagaaattgtatcaccaactttgattacattttttacactgcttatatgcagttcaatcatatttttaaaaatcatataaggataagggcgtccaaagtgattagtagcatcaggtgagtaccagcaatcaggttgatacccctgctccttggcactttttaatactggctccatcatcatatctgtatatccagtagttgagccaatcttaattcccaattctcttagttttgccacagtttctaaaacatacggcttaacatctgtatgttttgtaatacctgtcattaatgatgcctcaaataaatcataaattttatgtatatcctgttcattaaattcacgatcatatctagccttaaatgcttcattcaatactggcatttctaacattgttttaatatgatcaatcttcaacatccccattggttctctaatttggtcattagttggctctaatccataattattaaaagcatctttaaatgcttgaacaggagcaaaacaaccataatcaactgtagttcctgcccaatcgaaaattactgcttcaattctactcattatgctacctccgctaaaaaatctttaataattgaacataaatttaatatatctgcttcataaatttcaccaatattaccaattctgaatgtttgagcagtagttaactttcctggataaattgcataaccacgtgcttttatataatcatacatctcactaaaagcaaattcttttccttcaggataatagaaagtagtaataattggtccttgataagctaaatcaacatagcttttcattcccatttcagccattttttcaattagcaaacgattattatcataataacgtttacttcgagcagctattccaccttcttccaacatctcatctaacgcttttgaaaatgccagtacgacatgggttggtgaagtaaaacgccattttccatctttatccatcgtttcccattgatcatataaatccaatgataaacttcttgctttacctcgactagctagtaataaatttttattagcaatcacaaatgaaaaaccaggaactccttgaatacacttgtttgcgctacttataataaaatcaatccctaattttcctacctcaatatcaacaccaccaaaactactcatagcatcaacgataaatactttatttctttctttaactacttttgctacactctcaatatcatttaagatcccagatgttgtctcactatgaacgatagcaacatgagttatttctttttcttcatctaatttttcagcaacagctactgcactaggattttcattttcagcaaactcaattatctcatgattaattcttgcgtgctcacatatatctttcattctttttccataagcaccattagcgacaatcaacagtttttcattttcgccaattacacttgtaattactgactctactccaaaagtcccgcttccttgcatcagtactacagtatattgctcagctcttacatgagctaattctaataattggtccctaatttttaaagtaatttttttatagtcatcatcccatgtacaatgatcaaataacatttcttgctttactgttgctgttgttgttaacggccctggtgttaataatttataatctttcattttcttctcctacttacattcttctgataatttttgatgtttttctaataattcggcagtcaatttttcactaaaagtttttggatatgctgacttatttgcactatcactagtttctccttggtaaaggggattagggtaggtttctaacagctctttacgtccactttcaataatacattgtgccatcttcattgctaatttttgatgttcactaccatctttatttacgactgcaactgattcagtcaaactaaaatttccctctgttgggtcaacaaaatcgattggaagtccatcagctttatcacgtaccgcctgatgacgtagaccaaagccaatcgctacttctccagctcgaacttttttaattgggcctgatcctgaatcttcgatatgtgctccggcattatcataaattccttttaatacttcctttgctccatcttcgccatattcacttactaatgcctgaattaataaccatgctgttgatgaagatgctatatccgtaactgagatcatatctttgtattctggtttagctaaatcttttaaacaggttggtgtttcaagactatttgcttttaattcttcagtattaataataatagccccttcttgtgaagtaatcggtgtgtaataagatggatattcatctaatgcttgagtatcaaaacctaaatcaacaaacatctttttttgttcttgagcactatcaagataaaacgagctcattgttactagatctgcctcaatattagttccttcagccaataacttacctcctaattcagaagttccaaaagtctgaaataaatactgtccctcataaccatttttatctaatgcatttttcattgccgttacagcttcatcatcggcatttgaataaataacaacctgatcatttgatgaagaacatccagttaaaagtgaagcacaaagtaacgaactaactactaacccctttaataatttctttttcattttaatgttttcctttctcttctttgcttactaaagtaactaaatactcctttagctaataaattaattaataaaatcaagattgataaaacaaagatttcattaaatttagcaaaatgctgtaactctttgatctttgtcgtcatcaccatcgtccgcgccccagcaataaagataaccgcactaacagtgaccatagcattaataaaataataactaaatacttctaaaattgatgaaattgcattaggtgtaataactctaataaccgttttaaaccagctatcacccatcagtttcgcagtcgtttcaaatgaaccattcatctttgtcaatgagtttttcatcattaaatatggcgatgaaaagaaatgaacgatattacacaaaataatgatgatataagtattttggagcactgtcccagagaacattaacaagtatgctatccctaataccataccaggaatagtattagtagctagagcaatactttcaattatctttttcaaaaatttatttaaagtgctccgggcactagccagcgctgctccatatacgacaagtgttcctagtaatgctgtaaagattgcagtgattaatgaattttttattacccctagcaatgttgcatcactaaaaacattaataacattttgaaaagtaaaactaattcgatatggccactctccaacaaacggcacaattataattactataaagacagcaataataattacattaatcgttatgctcaatgtcccccaaaaccaatcacgaaaacgattctgtttgatttcaatcgtagagattttattataacgaatattatatttttcaagccgatgcaataaaataatactgatgattgaaggaatcagcattgtcattgcaacaactgccccacctgcaaaatttggaatacttcccaacatcttattgtaaagtacactagcaacaacatcatactttccacccaccgatgcaggaatcccaaaatctgtaaaacttagaaagaatgactgaataaaggctgcaaccaaagttcctaataaaggtcgaatcaaagtaatcattaatgtcctaaattcactatctttcattaatttggaaacaataataaattttttatcaatgtaactaatagcgttattaattaacataaaagcaatcggaaaagtatatataacataccctaacatcaatcccttaaaaccatatatatcaaataattgaaaaccaaataactttgtccacaacccttgttttccaaacgaatagataattgcaaatccataagtaatggtcggcaacaacattggcagcatcgaaacattattaattatccttttcaaccctttaaacatattcgtataatttaaagtgtaagcaacaataaatgccagtattactgttactagagcactcactccagaaacaacaaaactattttttaaagcatgcataaatcctgttgtttgataagtttgtaaataattatttaacgttaaacctccattattatagaaggattgtattaacagtgacccaattggtaataacagaaatatcccaaaaacagcaataacaattatataaataaacttgatttctcgatttttattcatttctttataccaccggactaaacaaagtcataatatttcttctttttatttccagctgatttaaaatgaagtcttgaacaaaatcacaacttggatgattaataatttcctctggtttaccaaactgagatatttttccttcattaataatcaaaacttgatctgataatgttaatgcttcctctggatcatgagtaacaataatagtagttaaattgtactccttagcaataatcttaattcgctctttaatagattccttgattactccatccaaagcgcttaacggttcatctaaaagaagaatcttaggtttcattaccattgttcgagccaatgcaacccgttgtttttgtcctcctgataattgatcaatctttttatctaaatgcttctccaatcctaacaagtgtatcagctcatctacttcttctttagttgaaatatccggtttgttctttaaaccatacgttatattttcataggcatttaaattaggaaacaaagcataatcttgaaagacaatattaaagcctcttttttccattggaacataagttaaatcctcattttcaaaaataattcgtccactatcaacctcactaattcctaaaataagatttaataaagtagttttcccacttcctgaaggtcctaaaattgaaacaatttgccccttaggtatctccaaactaagattatttaaaatatttataccatcaaatgacttaacgatcctttctagttttaacattctttttcctcctcgaacaactgcattatagctaactaaataaatttctatctattcttttttctttaaaacttggttaagaaagcgttaataaaaagaggtggtagatgtagaaaaactacattcacagctcctctttttgatatccacgatgtttaattaatctactatagtgatctagttttttagtgtaattatcataatcactgataatcacacccatatagatcatatcgactaatgcaatttgagcagttcgtgaaaaaattgcatctccatacaaaaactgatcattacttgttgataaaacaatatcaccatatcgagttaacatggtattttcaaaattaacaatagcaatcgtttgagctccagcatctttagcaatcttcaagacttcgactgtatttttagaatttcctgaataagatattccaatcgctaaactatcccttgtcagattacttgcatcaatactttggagatagtaatcactatgacaagtaacactctttcctaaatatattaatttagtcattaaatcatgagctacacccattgaattctcaacagcatatattgaaatatgctgactttgattaattaaagctacggttttttgataattcactaaagaaagagattttaatgcattttccagcatcgatgttgctgtagctacaattttacctggaagatccataattttatcatcggcgtttattgaaaaaccatataaaatatctatattattttctttatcataatttttagctaactctaatttaaattgtttgaaactgtcatagcctatcgctttaacaaaacgcattacagttggctgcgatacagcaacttctttggccaataacgtcattgataaatcttctagctttccacaataatttaatatataatcagctacctttttttctgatggacgtaaaatattgtatattgtttttatcctaaaattcactttgcttagcatattctctcctgtagtatttctactttattttctctttttatttatttttagtataagcaatattaaaaaaagctactatcatgctagctttttttatctaaagaaaaagtaatttttttgttaagaaaagaaaaaaccagatttttatctggtttttagattactaaggaataattattcctcgcgggttatcaagattatattctttagcgagcttaggaaaatgattatcaaggtatttttctaatgctgtatcatccaaacctttagtaagaatgtcttttatttttaagggatcattaattgtaattcctttacttgataatatctctatgatagaaacaatattttttaaactataagcctcaatcattattttttcatcatctaaaatgatatctagatccacataataattaagatgttgtccgactgctaaggtactaccataagtccaccttttaattattaatttttcaagattagactccacaattcctggattatataagcgtgaacacatcgatacgttaatctctttgatttcatcgaatgtaatctttctaattttattatcaagtcttaagattaattcttccccaatcaaaagatactcctcttgttgatcacctagctggtcaacatacacatttaatcgagcacgttcactttcctcataattaataactcgactaattttgttcagaacatcgcgtttcattattatcccccctttacacttttattaaacactatggtctaaaacaatagtcaagaaattctattcaaatatttattaattcaataaatactaattttataaaacgctatttagtatcgaatatatatactccatagattcttttaattaatgttttcttttcatcgaaactagaattgctagactaggtactaagaccaatctatatataataatatcatcacctatagcaattaatcttttgatcgttgaaatagcatttttagcaggatctatcgtttttagcataagtaaaccaaattgggaaagctatggcaaaataatctgggtgttttaaaatcatttccattgtcatataattaccatttgaacagcctcaaataataattcactaacatgctccaaataactcatcagcataaatagaattaccaacttgataattattattgcctccatcctcattgttgaactttgtagcactaaaatatattatatagataaaaaaatcctttgagatataaatcccaaaggaaatattattaaattccaaataataaatctaaatatgttggcattggccaatattcagcatcaatagattcttcaagctgatcaactgtttctctcaatgcttgcatcattgcaaaaacatcatcgcgccatgcaactgcctgttcaaaaatttcttcttcagaagcttgagctgcagcaatattagtttctaaagttgtcatttgttctttcattgtcttcactaatttagctaaagcattagcatcatcaactaagaaatcaacatctaaacctgcttccttagcagcaatcacttcagaagatacttttgataaataatcacaaactgctggataaatttgagatttggccatttttaacgctgttaacccctcaacctgaatagttttaatatagttttctagtaatatctcataacgagatcctaattcaactctactataaacccctaaacgatctaacatctctaaattcttttcttctttcaaacattttaaagcatcaacagtatttttattattaggaagtccacgttttgctgcttcttcttcccattctgctgaatatccatcgccattaaaaataattcgtttatgagctaaaacaaattctttaactacatcttcaaatgatttgcctgattcaatttcatcagccattttttccattgcgtcagctaaaattgcatttaaaatagtatttggtccagcaacagattggcttgaaccaactgctctaaattcaaacttatttccagtaaacgcaaatggtgatgtacgattacggtctgtattgtcttttgagaaagttggtactactgatactccagtggcaaaacgtgccgcatcagatttgctagttttcttaccttcacaaatttctgctaaaagagcatctaactcttcccctaagaacatagaaataattgcaggtggtgcttcatttgctcctaaacggtgatcgtttccagcactggcaatactcatccgtaataaatcagcataatcatcaacagctttaatcgtacatgcaagcgttgcaataaatggtttattttcagcaggattagcacctggattgaataaattaatacctgtattagtaatgactgaccagttatcatgtttaccagaaccatttaccccagcaaatggcttttcatgtaataagcagcgtaaaccatgctttttagcaatatcttgcataatttgcattaataaatggttattatcagtagtaatatttacttttgaatatacgcatgctacttcatgttgtgccggtgcaacttcattatgttttgtttttgaaggaattccatatttccataattcatgatctaaatctttcataaaggcagacactttacgtttaagactaccaaagtaatgatcttctaattcttgtcctttcggcgccattgccccaaatagagtacgtccagttaactttaaatccattctttcttggtaatatttatcatcaactaagaaatattcttgttcagccccaacagatgcagtaactttagtaattcctttttcaccaagcaaagacaataatcgacatgcagcattagataatgcatcacaagatcgcagcaatggtgtctttttatctaatgcctctccagtgtatgaacaaaacaaagttggaatatataaagttccatctttaacaaatgccggtgatgtacaatcccatgcagtatagcctctcgcttcaaatgttgcccgtaatcctccagacgggaaagacgatgcatcaggttcaccttttcttaatgtttttccactaaattctaatactgctttgcaaccgtcaggttccaaaaaagcatcatgtttttcagctgtcaaaccagtcattggcataaaccaatgggtaaaatgtgttgcaccattttctaatgcccagattttcattgcattagcaattactgttgcgcattctttagataattcttcaccattatctaaagactcatggaatgccttgtaaatagatttaggaatccgttctttcattacatcatcactaaatgccaagcatccgtaatcttctaataacttattcatttccattctaagttcccccttgttagtttctaaacaacacataaccatacacttaatatatgtttatatgccgttattatacagttactttatttaggtgtcaatatctatatgatatttttttatcattttgttaattctttattaaaatgataaattatttataactgtttacttaaagatacttattacaactaagtaatattccatttttacaaaagaaaaagatgcttattcagcatccatatttgcttttttagcttcttctttcaaagctcttttgcgtttcttttcatatgatctatgagtagctgcatattcagtacattgcacatgaattcttttattagcagctacaatcgcttcaataaatcccattctatcttttggtgttacaacaaatctttttttattttcagcataaatttctaatgcccgtggactagttataagttttgtcatctttggtacaggatcacaaattgtttcacatgtcataatattaatttctttatctttaccaacacggcgattaattatcaatgttctacgattaattgtatatttatatggtcgccataaagaaaaatatgcaataattaataatccacaaatagcacacactatcgcaggtaccatttgtccaattataaataaataaactacatataccatataaaagatttcaaagtatagtattgcgggattcaatttaattttaaactctttttctttcataataacctctctttttcctcaacttcatcattataacgtatcttaaatactataacaattataaattatcaatcattgataacttatagttactatattattaaataaagaaagacgggaaacccgtctttcgattatcaaacaagtttgttgaattattctgcagcttctgcagcttgtttgttttgatatctttcataagcaattaagaatggtacgtatactaagatagatactacgattgcaattgcttgagatacagcacccatgatattagctcctgtagttaagaaaccatgtaagataggtggtaaaactaccaatgactatggaacggtcaaatttgatcaattagaaaagggtgtttatctgcttcaggcaacagatattaacaggtatgagaatatcatgcctacattaatatccgtacctgtatttaacaatgaaagcaaaaacggtatgaattatgatatcagcatcatacctaaacattctcctatagctgcagcaaagacaaatgatacagcaaatttaaaaatatttgtcgtattagcaggcgttagtgccgttattattgcaataatacgaagggaggcgatatagatacaaattaatatttattagatatcaaaacgatatcttttttattttaacttaaagtgaggtagagaaatgaaaggattaaacaaaataaaaaaatgctggaaacagcttatactagcattaacaatgatattcagtataagtacagctacattatctcagattaatgccgagacagtgaaacttgaaaaaggtgaggcaataagatatccaagttggctagggaactggtctactaactattattatattaatggacagttatcatattgtctaaattcttctcgaaatgaaccagtaaataatgattcggcaatagcagaaattcatgaaaatgaagctcttttaaaagtattatattatggatttggcggaccaggtgatgtattcagagacgatcaggttacaaatgatactactaaatatctttatacgcatattatggctagttacgcatacagtggagatatttatggaggtaagagctgggaagatttggaagctcatggtgttggtttaaagacaagatatgatcaaattcagtcaatgcctgtaccaactaatccattttatttgaatggtgtacaagatttaaagttaaaagctttctatgatggtaatagtcagagaacagaaaatatttattttgattctcgagaagataatactttaacaattccgcttacagatggaatcgaattatataatgtgactaaaggaactacttcaaaaggcaatgcaataattaatggtggagatactttttatttgaaagcaaacttagaagtacgacaaaactatttatctggtaatctaactggtagtgcaaaaacacgctatgctccactaattgtaaaatcagatagtaatagtgttcaagatatcggttcttggagttttgcatatgctcctgcatccttaaattttgaagttgagtgggctgatgttggaagtcttgaattaactaagaccaatgatacaggagaattattaaatggttcggaattcaatttaaagcatacaactttagagtttgaaaaagatttagttgtaaaaaacggcaaaataaaagcagataatttaccagttggtgactatattttaacagaaactaaagttcctgatggtcatgctgctattcaaaaaacatttaaagttacaattaataaagatcagacaacagaaagaattgtagtaaataatattagacctactggtagtttagaaataaataagtcattagaagcctctaatgaaaatgcagtaaataaagctgattatgatttaacaaaagtacaattcagattgagatttcacctgttttagggaatttaataactgttatattttgttattaaattctctgcaaacccttgaaaacactggatttatcgcaggtgagctttcccttattgtttcccttgtgttatatcgtcccgtcagcgtttacgaactctgataagggcaaatacaagggcaagaaaaatctataaaacagtataacacaaaataaaagtgacatggtgaactgattgaaatgcttctgatttttgtaacaaatgactgattgaatgataaggagattctatacgatgagaacaatatttgcagaatacaatccacacagaaacagcattgatatttatacttctgctggttatatgctccgcattgactgttgggaagccgaaaaggatttaaaaaccacacccggatcagactgtgcattgaacgcacttgccattgataaaccgcttgaatatgcaaaattatatcttgatgaaacaatgcagatatgggtagatgcagaagattcattagaactatggtgattttttcaacagcactaaggttactttttcccaatctcatttattgagaatcgtctttttaccgtgcatatatattcaatatctttttatctattataatgaaatcaagggctggtctaatgccagccctacaaaaatgaaaattcacatagaaaataaatttacaatttttccgatataaacctgttatcaacaaatacaaacataatttatattatcgtatctattgatatgatatgtatttcaaagagttaccagaagtttttgaaaacttttcccttgtgatattatctaaagctcctaattttatacttttcccatgatggagcagcttatttgaccgtatctttaatagctgtatttttgtaattagatgtaacaccaccggattttcatccgttgaatcatccgcatatttaagacaataagaaagaccggtgccattacctcctgtccacaacatattatctgttgtgaatatctgatataccttcggtgtttctgccgtataaaatgtcttttccccagatgcaggcgttttcatattattgcctttttgttggcggtacattgaagataccgtatttagaccagaaccaatgtgcatacttctgttcctccaatcattttatctgaattgtaaatgtactgcttctctgactgttttcagtgtccttgaaatagtgtcaaaaagaggtgctatgcctggcttaactaccgtatgttttgcacggtcttttacatcatgcactccaaatccgtaacacatatttctgccctctgcggaaaaattcacggtatctctgtctttatgtacatttgaactgcttttttctgcatttatgtgttcccgcatttcagaatttattttatatccatcatactgaaacgccttactctgcctactgtaaacttccaacgacatatccgtgtcctcctcagattttcgtatctaatgtagataataaatctacattatcgtattccgcttgagtatatgctcttaccactgaactactgttttctgacatttcactaatatactcatctctatctttgcgtttctcacgcaattcttccaaatattcttcatctctttttcgtttctcacgcattttctctaagtattcttcttgctcacgttttttgtcccgtctactttttgctgctttttgttgattttgtgtactcaatacatctgaacttttatttgacgaattagctgttctcataccaccacatgaagattgccgatttccattagcatcatatgtaactgtcctgcctcccaactctacaccgtcacgctttgcaaaagaatatacttgtgaatttgctgcaacctctccggataaattccattctatttcttttgcgaattccggatcattagccatttttttcaaacagtcataagaaagatttacgaccactttattggaattgcaaggcacaacaccgccgttggtattaaaacttatttgcggaaactttttacataatttttcataatattcttccacactattagaattgtgttttgtgtcacataagggtgcgggtaataaggcgcacttgcagcctgttacgcatttcctcgtccacataggaataggtattgcccgcgtcgtctttcagcgtgcgggtacaaagtttcgctatgtaaccctcgtaatgcttcaagatcgcgcacatggcggttgtgtcgccgtttgccgctgcggaaatgacagggaacggcaacagattttcagatttcctaacggtattcatcatctgcttttccctccaaatactgtttgattttcgcaagcgcggatttcctgtgccggaaaaccgtcgtgcgtacaacattcagcagttcagcaatttccgcgtcgctcatgtccaagaagtaggacaaaaggataatgtcgcgtttcctttcgggcaaagcgttaagggcttcggcaagcagttcatttttgacgagtacatcaaagccggacacttgaaaacggaaataatcgcttttgtattcgtccgttgtgaaaagctgcgcgagttcgctttcgctcaaatccgaaaaaggtacttcgcgtgctgcgcgtttcgcaagagtgcggcggtggcttttcgcttcgccaaccaaagttttctttgctaatgcgtcgtactgatgttgtattctttccttgtcggaagaagatagctccatagagttcacctccttcccgcgtggagtagaggacgggagttaagggcttgtcctctctgcccctttcgctccgtacccgttcgggagatggctcttgagtgcgtttttcagaaaaaagttgaaaaaagcaaaatgcgcccgtccgcaagacgcggacgagcgcaaaggaaatgtaagaagtatttagatgtattgacagttcatactcatagccggaatatcccgcttgcggagcatagctttttttgaccgcaaagcattaggcgggttacagtaaataaaaatggacacggcgatacctccccgataccgccgtatccttaaaaaagggcgactttaatacactacccgcaatccattctataatagggaacagcggcttttgcgcaatattaaataaaaaagccgataacacataggttttttgacctaatgcgttatcggctctgcgtctatgcgtctggcacttttaatcatttttttttgaatttattatatgtgttagctaactgtccacaagccgcgttaatctctctgccatgagaaactctcatagtaacttcaagtcctgcttgctctaattgatgtttgaatgcaactatttcccgtttctgtggtgctttaattcttgaattgcttgttgggttgtattgtaacacgttaatcataacttttttgccccgaaaccattttgcaagttgtcttacatctgagggccggtcatttatacccggtaaaagcaaatacgcaaagacaattttgcgattatgcctttcagaataggataaggcttgcttaacaacatcttcaatagcatatatgcgcatgtgaggaataatacgatttcttgcagattgtgttgctgcgtgtaaagatattgtcaactgaattttaagatgttcctcgcgcaatttttttaattgatcgaccggaccaactgttgatatggtaatgccgtcggttggaaagttgagcccatatctatctcggagaatatggattgcttttatcaagttgtcataattgaataaaggctctcccatacccataaaaacgatacggtttacttttcgacgcaacaatataatctgttgtacgatttctgacgatgttagattacgaacaaagccatttcgcccggactcacaaaaaatacaaccaacaggacaaccgacttgtgtgctcacgcaaacagttccaccatctcgccgcttgataaaaaccgtttcaatgtatttgttgtctttcagttcgtaaacatacttttcagtatcactgcttttgcaaatattttttaccaacattgatagattttttttgcgtggtaattgcttatataattcttcatataaggcttttgcttcattctcgccaataacttccgacatttctttgtaagtaaatccgtatggatcattccgtacttccgcaggcgtatatttaggtaaacgtttcatttttatatcctttcttctaaataataaaagtttgtttttctgtatttttgattacaatctctaatttttctacatcaatgatatgcgtcaatttgcatttagggcagaaaagaggaaaatcttttaatacagtattatgaaatacttgaactctcgtctttccgttacaaatcggacattttatccaatattttttaagcattatatttcactcgtcctttttacacaaaaaaatgcacagagcagtacaacaaaactaaggcatagcttgcactatgtctatactatatctatacgtcgttagttttttgtatagcatccgcaaaataagcatgacaaaaaagcccatgttgaaaatgggaaaatcctttttttcaatgcttatctaatacgcatgctatgcaacataaacgccgcctccttttacataaattttattttatcagaaaatcagtctactgtcaatacacaacaggaagtatttaacctaatgatatgaattgtgtggacatatccaaaaagaaaggtgaactgtaaaatgtaacagggtgaatgaaaatggcaaaaagacccgtaccattgtacgactttaaggctttcggggcagctataaaagccgcgagaaatgaatacggcgagagccgcaaaaaggtaagcgacgagttatatatttccccgcgctaccttgcgaatatcgagaacaagggacaacagccgagtttacaggtattctatgaccttgtaacccggtatcatatttcggtagatcaatttttcttcccgaacagcaatgcggagaaatccaccgggcggcggcagcttgacgcgctgctggacggtatgagcgataaaggcatacggattgtaaccgcaacggcaagggagataacagaagtcgaacaagcagaggactaacctcacaatatgggaagcaggagattgcagcgcataggggctgcaatctttttttgcgccaaattagaaagagagtgcaacaaacgctgcctttgaaacgggataaggagtagatagcaagcacagcaaacgagtacccgtttgcgaaaagtgcttgttgggataatcccaaacccttataccgaaaggcggtgcggaaatggaaaaccgaaagagaaatatacagatgaagttttacgttacggaagaagaaaagcggctgatcgacgagaagatgaagcagcttcccataaagcagtatggggcatacttccgtaaaatggcgatagacgggtatattcttgtcgttgaccgaagcgacacaaaagcatatatccgggaactgcaagcggtgagccggaacatcaaccagattgcaaaacgcgccaatgcgacggggacggtttacaggcaggatatagaggacattaaaaaggcggtggacgagatatggcggttacaaagacgcaccctattaaatcaaccttaaaggctgttcgcagtacaaacggacgagccgcacgcagaactgcacgcagcattatatccgagaggacgcattaaaccagttggttttgaaacagcttcagcatttcctgtcctatttacagcagtttgagcgggtatttatccgacggcagatagacaccacccttgcggaacgccgatacgaactgtccgcaaagcagaaacagatagaaaaagacgaaaagcggatggatgagcttgaccgcctgttccgcaaaatctacgaggacaatgtcagcggaaaactgaatgacgaacgcttttacaagctgtcagacggatatgaagcggagcagggacagttaaagcgtgaaatcgaagcgttgaccgcagaggtcagccaagccgatatggaagtgaccaatgtagcaaagctgatagccgtcacgaagaaatatacccgcattgacgaactcacgcccgaaatcctaaacgcatttgtggataaaatcgtaatccatgagcgtgagaaaaaggacgggaaacggacacagcaaatcgacatttactattcctatgtcgggattgtggatattcccacagacgaggaaatgcgggaaatggagcgggaatatatgcggcgtactacacgtcaaaccgcctgaataaaggcgaaagcaggagtaaatctgtactcctgccgatacatatctatttttatccctatctggtttaactcatttacaagaaaacttagatgtgcccgcacgaatcccatatccttgaattcattttccagttcatccagttttttataaatctgaaacgtacctttttcagtataaaatacatttttgtgaagttctgtttctatataaatgatgtcatctgcatagagttttatcgttccctccacaaaacgaaattcgagaatcctacggtttttattaatttctgctatcaaatcatccatacattcttctatagtatctgcaaggttatctttcagcagaaaacggcttgctttcaccttatatccatccagtgcgtaattcatgtatgccgtcaccagcacaaccggaagttttggatatttttctttaatcctcatagctgttttcagcccatccatcccctgcatattgatgtccagaaataatatctgacacgcttccaaagctgattgttcttcgcataactgttctccagaatcatattctgtaatagcaaactcataattctttttttcaccatagtctgacagcaaatctgatagattttttctgtcatctatcctgtcatcacaaataataatgttcatatttttcattcctgtctttgatttctctcatacctgtaaaccatacaagtctcacctagcactctttattatatcaaacaaatcttccgctcgatcattctccgcatcaaatgactattttccgcatagaacgactatctcctatagaaacgcagaagcattgtatctcaaactctttgaaatacaatgcttccctgcattttctatatcggcatgttgatattattactttactatcctgcacactctctgagagtgactgtatctatcaaaaaagaagccagcagtttattcacgcactgctgacttcttataatactactcattttatttacttcgctgcgtctcagacaatttttttatttttaaacataacctctgttttcccgccatccctttacataccacctgattccaacatataccagttgcacgaataataagagaaatagcagattgattggcaatacttcctttatccaatccccaaagtagatagctattgccatacttacaagtatcaccattatggtaatcatatcccaacagtatttcttatatagccctgcaatctttatttcgatgaatgccaaaagtattcccacacccaccagacatccaccgcaaatcaatattcttatcagccagtttataattccagcaacgacaggattggatattccatcactaatctgtgccacgttctttcctgccagtacaacccagccagcaatggtctgtgtgaaagttgcgattgtatcaaagaataccacgcaatcagaaataaatatttttgaccgtatcatctgaaaaagagtagttgatacggaataccatatcagcagaaacatcaatgcttcatacatggctgtttttgttttatatctgcctgccagtttttccctctgcatatcatacttttccttagctttcagataagctgtctgtttacaattcccgcacttttgatagagtaccggcttttcaaccggtatctctacttttttctgatgggagagtgcataatcccgttcctgttctgcctgtctctgcttatctcgacattcctctatcatggcttggacggtgtgtgttttctctttctcgctctgcaacaattcttttgttttcctcaagtcgttctttaaggcttgaatgttctctgttttgttctcgctgtttaacttctcgttcaaggtcagcgattcgtcgagctgcactttcagttccctgatagtccggtctttctggtcgagttcttcctgcatctgctctgtcagcagaagcaactcttccagttgatcgtcgctctttgagtttcttaattcgttcatcaatcaaccttcctttctctaattgctgttcaagttcagtaattcgctgttctgtttctgcaatagccggttctcgctgtttaatttctgtgccaattcctgccattgctgattttcgtctgtgagtttctgtatctggtctgtcttttcttccagaagcatcaacagttcttctgtatccggtaagatttgtagcagctctgacaattctttctctaattgctgcaatcgttcttcctgctcctgaaagcacatcagcttctcgtccttttcctgtatctcctgaagcatctctgccatgatattctgttgttcctctatctgtgtaatcattgcttccatcatgggaattacttctttgctttcttctaatgtcattcaaacactccctccacatagacaatgcaccggataccttaccaaaggttgcaattaccttttgcagcagtgcattttgttttttaatcatctggttttcctcaaccttccatgaacctttccttatctgtccggtgagatatttttcctcaatctttcttgcatccgcaccctcatgaatcgtagggactttcaatttgccctgtctttcataagagcggtggtcaatctgattgtctatggataaatgccggttacacatcctagcccattcgcttcgccataactcacaattctttggattattccagccggtagcatcggtcagaacccgtttccattgttttcggtttcttgccccgactttctgtactccgttttcatcaagtaccggaatgcggattccatgccggtcaggatttttcttatcctgccaccagtccgggtgggattcatcaaccacgatatttccgtcagtatctctgacaaaatcccagtccttgacttccttgttgccccatgagtggtctggattgaatggtcgcatggttacaagtaaatgcacatgtgggtttccatcgttcttatcgtgtatgctccagtcgacacacattcccttatccacgaaagtcttttgaatatattcggttgtataatcaatctgttcctgtctgctccattctttcggcagggaaaattcaaatgagcgtccaagctgtgcatctgcatttttttctatcttcaatacctcattccatagacgctgtttctgaaatgtgattttaaacttttccagtgcggcatctttatcatccgctcttttataacggatagactgttgaaacctttttatattttcttccggtacatgcagccattcaggaggtgcattttcgcacatcatcagactggtgtagacgacttcctttttggaagtatagtaactgattctgcctgtttcctcattcttcatcacatctccattaagatatgccgatgcggatatgacagattttcctttactgcgcccgacaatctttactgtaaagtgaaatatcgccatgatacgattccccctttctgccgtatccggcattgatttccgacagcatcttcttctggttttgcaggagtgaagctgtcggaacgccctctgcgcaagagtgccccttgcggcatgagcaggtctggctgaaagccccgccgacggaacgagcccggcaagcgtaagcgcagaccggttgccacttgtggcaaacttataaggacgacctctggttgtccataagtgcgcccttcattcaaaggcaatgaagggaatggaaaaaccactccctccgccattacacttcctccatatctgtaagtggctctttctgcatcgcctttgagaaaaactttccgtttgtttcctgcctttttaagaagcctatcaactttggtaaatcttcctcctcaatcggacagccaagaaccgattccaccgcaccgccaatctgacagagcctgtgggttcgttttttactttcctcggctttctttctcttttccagttcctttcgctgtgcaatgagctttttggtagcttcgatgctttcctgttcctttttctctaatgcacgtattctttcttcataagtctttgttgatttcgccatatcgtcttcatcctttctcttataatcaaatcttgctctgctaagatttggcacacgattctggtcagctctgttgacataattccaatcagaatcgtggtgcatccttgcggagcattatcttgtcgatgtttttccgacaagataaacattagttcccggttgcatatcaggagaagcacatggtataatcctcttgcgtgtaggtatatcatggcttcggtctgatagaacctttggcggtttcgtaggaagccgcctttttaagttgccacatttcttgtgacagtttttacatttcctttatccctcagatctcgcccctcgttggcttccatgaacttttctaaaatgtcagttttaataaggacttttcttccgacttttaataccggaagcttcttccattcaaccagctttctcaaagtgtttctgccaattcctgtatagtcggctgcttcctcgatggataatgcaatctttctttccgtcatcttgtcacctccttatgaattgcattatgcaatttttgttgtgctgttagtatagcggttttatattgtgttgtcaagcgttatgaaattttaaaaataattattatattgcatattgcaattatgtgaggtacatgctataattcatacataccgaaaaaggaggcaatcagcatgaaagataaagaactacgcaagctgataggcagcagggcaaaacagcgtcgtctggaattaaatctgacacagccttatgttgcagagaagatgggagttaccgcttccacaatcctgcgttatgagaatggttcgattgacaataccaaaaagatggtgctggaaggtctttcggaagcacttcatgtatctattgaatggctcagaggggaaaccgatgaatacgaaaccgatattacggataagaaagaattacagattcgtgatgcaatgggcgatattctcaaacagttacctctcgaccttagtaaaaaggaagatgctttttccaaagatttactgctgttgatgttaaagcaatataacctgtttctggaatcattccagtttgcctgcaagaattacaagggcaacacgaatgaagctgatattgcaaaagtaatggggtttgaatcgaatgatgaatataacgagattatgtttctccgggagatcacccacactgttaatgcctttaacgacatggcagatatcgtaaggctttattccaagaaaccggaaatggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagtaaaagtgaaacggaaaaactgctccgtcaggcaatggatgattacgaaagcaagaaatttgtcgcaaagacagataatcttactgtaggagaacttcttgatatgtgggcggaagaagaactgaaagtcggaacactcagcaatggtacagtggaaaattatcttggtgcaatccgttgtatcaagaaacatccgattgcagaacgcaaattaaaaaccgttactgctgaacatttacaggcatttctcgatctgcttacattcggtggggaatttccagatggaaaagtgagaaaaggatacagtaaagattacatccattccttttcagcagtattacaacaggctttccggtttgcagtatttccaaaacagttgattacttttaatcctatgcagtatattaagctgaaaaaacaggcagaggatgtggatttattctcagatgatgaggtagaagaaggcatacagcctatttcccatgaagattatgagagactgatagaatacctcaaagtaaagaatccacctgcaatcctgccaatccagatcgcatactatgcgggacttcgtatcggtgaagtttgcggattgacatggcaggacatcaatcttgaagaacaatgcctgaccattaaaagaagtatccgctatgatggcacaaaacataaaaacatcatcggaccgaccaagcgaaagaaagtaaggattgttgattttggcgatactctgactgaaatactgaaaaccgccagaaaaaaacagcttaaaagccggatgcagtatggtgaactttaccaccgcaatttctacaaggaagcacaggacaaaaacagagtgtattatgaatattatcatctggacggaaccgaagaaatcccggtagattacaaggaaatctcctttgtctgcctgagaccggacggatgtctggaactgccaagcacactcagcattgcctgccgatcagttgcaaaaaggctggacggatttgagaatttccatttccaccagttgcgacacacctacacaagcaacctcctctcaaacggagctgccccaaaagatgtgcaggaactgttagggcactctgatgtcagtaccacaatgaatgtctacgcccactctacaagaaaggcaaagcggaactccgccagacttcttgataaagtggcaggcaacgactaaataaaaaattcccttatttcccttgctgattccgcataaggtcaaaaataagggaaaatacatatcatttcactatttaaggggctggaaagcccgtaaaataaggaaagttcaagaaatctctccacaaattcaagattactgcaagccaagatgtttacgatagtgtttctttagaaaaattatattctaaaggagatgcaatcacagtaggaagcggtaagggatcaaatgaagataccgttagattgattaatggaaatgaattaggaaatggtatttattcatgtgatataaatggtaagttatctttatctggtttgccaatgggcacatataacgtggaagaaattgcctgcccggatggttttgttttagataaagaagtcaaaacagtacagtttgcacagcaggattttgttacattagaatacaaatcatctttggatattaacaacgagcttactaagacagtttttaataaagttgatgtagcaggaaataatgtttctggtgcatatgtacagattctaaatgagaacaaagagttaatttatgattttattacaggaacagaaccagtacaagttgatggtttaaaagatggtaaatattattttcatgaagatttagctcctgaaggatttacattagctcaagatgttgaatttaatgtaaaagacggtaaaattcaaaaaataaaaatgacagataccattactgaagtggctaaaaaagatgaaagtggcaatttattagcaaatgcagacatggaaatcatttctacaaaaacaaaacaaattgtagataaatggactacaggtcagcatctattggacattcctgaagatatcaaagtacagttagaaaaaggtgaaacagtttctaatatgtttgtagatatagaagatgatggtgtcgtagagtatacaattcttccaaataaagacactaaggattatcgtctaatttatataaaagatggtattacaaaatactcgaacattgatatcaatggtgatgaaacaactcatatggctcaaaatttaatcagtggccaagagtatgtcctaagagaagttaaggctcctgaaggatacaagatagctgaagaacaaaaatttattgctggaaaagataaagacgtatcattaagtatgacagatgaacttatattgacagatattcaggttaataaagttgacagtcaaacattaaaaccaatattatcaaaagattttgaatttactctttacagtgataaggaatgtactaaagtattagatgtggtaagtggtaatactacagatggaacagctacttttaaagatttaaagtatggtatctattatatcaaagaaacaaaggcaccgttaggataccaactttcaactgaagtaaaagaaattgttattaacgataatctagaaggtgtaggaaacgtacatagttttaaatatttaaatactttattgcctgtaacaattacaaaaacaggggataatcagtcattaggattatatgctggattagcggcggtttctatacttggattaggctatatcatacttaaaagaaaaaggaaagaaatctagaaggtaggtcatttgacctacctttttcattaaaataggtaaatgtatgtcagtaaaaaagaaattaacaatattcatatgtatattatttacactgtttttatcgggatgtcagacacgaagtaaaaaatatgaagtaaaattcatagatgaagaagaaattgaatattcctctgattttaagcctgctgatcttcttattggtgtaaataaatataaaaaagaagattttaagtttaatgatgattatagcttacttactttacctgataactcaacggttaaaataaatagcagtgagaagaaaattaaattaggaactattaaatttgattttttatataaaagcaaaatttataccaaaaaaatcttattaaaagatacaacagctccagagatcatagcaaatgatcaatatgaagtagaattgaataatagttattttgatttgaaaaatcaaattagttgcaaagataattacactaatagcagttctatagaactgttttttaatggaaattatgatcttactagagtcggctcatataaggtagaagttattgcttatgatgctaagaaaaataaatctgttagagaagtaactgtaaatgttgtagacagaaaagttgataataattattctcaaccagacaataataacagcaataattcaactgttgaaaatagaacaaacagcagtgacagtaaaaatagtacaaattcttcaaaaacagaaaaacccaaatctgatactgataataccagttatgtaccagaaacaaaatcattcagagttgaggaatatggcacatttgatgcctgtttaaatgcctgtcaacagtatatcaacacttgtctttcaaaaggatacaaggggcttgggaaagcccagcctattcaggagaatggtatatatgtaggatatcaggcagtttttagttgagaaaggattaaaaaatgaaaaagataagaaaatttaaagtagcaattgctactttcacgatatgtacattaataaaattaaatagtatttcagcagcggtatcttttaatcaaggtcaagctacaactgatgtaaaggccatacttgacccaattgctaatgtcatgattgcaatttcagtaccacttgcaatatgttcagcaggttattcatattttacgtggaatggcaaggatgaggaagaaaaagaacaaatgccgtttcataaaacaataaaaaaacatgtaattgcatttattttgttcggcctgttaagtacgatattaaaatggtttacaatctcataagctggaggtgtttatatgattgaagatgcgataaggaatttattttgggctatagcaaaactttttttatcagcaagcgactggatgtatgatatgctaaatgcagtagttaatttgaatctggcaggaagtaatgagataacatatacatggcttttcttcttgtcatttttatcatttgctacatttgttagagtaggatacgtacttttaagaaagacagctaacgaagatgaggaagtagatatcggaagtatacttaagaaaataactaatatttttctagtaatatgtatatctcttactgctttcttttttgcgcttcaggcaccttcagagattactaagatatataataatgtcgtaacatatgatgagaaaatgtctccttcaacggcggttattagctcaactgctaaaactccaattacatctaaattaagtgacatgtcatcttcagatgaggttattggaatcgatacaatagatgataaattaaacgatgaggaaaatggtgagtatatttatttttactcttattcagaattgttgttgtgcattataggtgcttttgttgttatgtgtgtacagctaaatatagttatagactgtgctatgcgtctgtttttaaatatatttagattttgtataggttttattccaatatcttcaatggttgaggaagaatcaacttgtggtgactgggttagagatataatatcggatgcactaactacagcatctacattaatatttacaaatttagtttttggtcttatgacattatcacagatttcttctttgaacggtattataagagttgtaatttttgctgctggactaataacagtatataaagcaggagaaataattgcaaaatatatgggtgcttcaaatctttcatctggtggtagagcaggtacaatgctgatgggaatgggggcaatggcagctacaaaagctacaatgaaaataatttctaatagtgcaaaaacttttatggattatttaaataacagtcgtcctatggatggtgggccaatggtaacaccaccatttccagacggtggtaacgggggtgggggttcactttcaggatccataccgccaaattcatcaactatgtttgaaacagaaaacagtaatggttattttgcagatagtggtttaaatcaacagacaatgcaaaatacatatcgtgatcaggaacagaacaatggcagtataatagatcagaatcctacgacaccatcttatatggatagtaataaagttggagttacagaatcgtataattcaggaatctctccacaaaacaatacagtaaactctaatgattatgataattctggtaaaaataaatataattcatctgatagcacatcttttataaatcgtggcggagtatcttttgtagatactccatctcaaaatcatttatataaagatagtgcaagagtatataaaccaagtgttagagaaaaatatgtaccagatttggctgtaagtggggtaaatgtatgagaataacggatattaaaggaacatgtccatcaaattataagtcatcacagctcatcataaataaatatagacctattgatatattaataatgagttctgccttcatttggggaatagtctgggcaatattattattgtttgtttttgttcctacgatagtttcatttataatgctggtattggttgttcctattgtaattataggattggttcaaccaatggccaattaccataacaatttagaatatatattacttactatgaaatatcatttatcttctaaatactatagttatttagtaaagaaaagaggaaataaacagtgagtggagtcatggaatttaaaatatacgaggacaaacttaaacacaatattttagaaatacgtaaggaagaaatagattttagaaaacttgtaggtgatacatataatattgcttattataaagatttaatgaatagaaatattataattgttgtagatgataatggttatggtaaaaatttaaaaactacatttgtgttaggaaaaaaattacctgaaggaatcaaagtatatagtgaatacgaattaaaaggcaatgtatacatggccaaaatatataaaaaatctttggaggaatacgagtttgatattttatctgaagatgatatacgatatgtatttaacaaaatttacgaatatagtagcggttatatattggcagttcaataggtaggtcatttgacctaccttattttttgtggaggtttgatatgtttaacaaaaagaaggactatactaaaagttataaaaaggcatttaaaagtatagatgatttaatagatattaaagaaatttacgatgattgtattttgctgaaggataaaactattgtaaagggaataaaagtatctccgatagatatctggacctgtcaaaatgcatatgcggaaaaagttataagtgcattacgctatgcttttaatcaatttaattttccagtttatcaggcaatggtatattcaccatcaacttttgaagaactggctgattcacttgttaatgaacttgaaaatgcttcagaagtacaacagagaattattatagacgatatagaaaaattagaggaattctcattaaataacaaaaaaattgaattcttttgttttataaaacacaaagatgaaagaatattacaaagaagatataatcagcttactactgagttatctagatcattttatgttactgattgtgcatatttagattacaataagtatttaacatggctttttgatttgaatgataattttttatctaaggcttatttcaagggaaggactttattagatgagtcggtaacaaaagaacagataaaagagaaaatacaggatatagatatagaaataattaatgaagaaaaaaatgatttggatattaaatataaactgtttgaaataacgaatagtgaagaatattttacaataaatggtaaatactactcagttattattgcaaaagctctccctaagagttttgatgtggggatccttaattatataggaagaaatcagaatataaaaactttttttataactaaagactctgaacttgatttagtaaaatgcattagaaaagaaactaaagatttaaaagataaattaagaagtgcaacaatcagaagtgataaaacaagggaaaaagagttgcaaacaagtataagttcattggatcagtttgcttcagagatggttcgtaataaagataaaacattggatctatctctggcgatggttgtgtctcattttgagttcaaggaaatgcagtacataaagaaaaaatttacggatgaattaagaagaataggttttacggtattagcgcctaaaaaacttcaattagcactttttaaatattttaatcctattttttatcatgattatttaatttcggatacattagaagataatattggatttcctatatcaacaagttcgtttgcattaacatatccatattatttttcaacaaatgaggatttgaatggctttttatacggctatgaagcaaatatgaaaggaagaatactttttaatccgtggtattatatagatcaggagaaagaatcggtttttgaaaatagattaactggtaatattatattgttaggagatactggttctggaaaaactacagatttatatctgctttttaggtattttataagacgtaataatttcattatgtgggttgaccctgaaaataaaaataaaaaggaaacacttaataaaggtggtacatatcttgaatttggtaataaggagcatatgttcaatctttttcaattaatacgtgtttctgtagatgatgaattgaatagcgaagaactcagaaagagaatgtgggattcagagatggccataataaatgcagtagatacatttaaaaatgtgcttatactatataacaaaaatatagaagataatacactggcagttgtaggtacagttgctcaaaaaatgtatgaaaaatttggatttttggatagtgtagataaaaacggtgtacaaattaaagcaaaatatcctacatttgataatctaaaaaatacagattatccaacgcttagtgattttgcagatacactaattgaagtgaaaaatttatttgagagtatgaatgaaattaaatttgcagatgcatgtgaggatctatttttaaagataacaccaatgttatcagaacatagatttttatttgatgggcatacaacggttgacatagaattaaggcagggtaatgtactcggtataggaactaaaaggctttatactatgacagaaaatgttagaaatgcactgcattatattatctattctcaggcgtttaattattgtttagatgataaagtgaatagtgcttttatttatgatgaggcacacacgactatgaaaactagcaatattattactttattagatcagttcactagaagaagcagaaaatataataatataagtttattgggtactcaagagccgttagattttggtgatgaaacacagcagtctattttaaatcagactacttatataatttgtaaactgctttctaaacaaaatgcacagatcaagctgcaggaaatgataggcttggatgagcgagatgttaaaagaatatcaacatttgtaaggggcgatagctattttatatgtggtaataaatcattctttatgcatacactattgacagttaaagaggaacagcaaaaaggtaataactatgcttaaaaaaataattgtagtggctgttgtttttactcttgtatttatgatacctgttacggttgctggagcaatagttagtgatccaattggttttattggtgaaattatttttggtgaaggagatacagataaagtatctaatgaagttaaaaatctatatgaggaatttataaaaagtgaaataggaattaaatgtaaagactatgtatccgataatactaaggataaagagacaaaatataatgattctcatttttttattcctttactactgacactggaagaaaaagcaagtgataaaaataatacgttcgaaagccttaatttatctgaattacttgataaattgattactttaagatatgaaaatgacaatgatgatgattatatatcggcaataaaaaaagaggccaaatttaaaaaattaagcgatttatctaataccactattgtcatgtatataagatattttggtgataacagtaatgcatcagataatgttgaggtcgagggtaacagtgaaattggtaaagcaatagcaaactcagctttgagtaaacaagggtgtaaatatgtctggggagcatctggaccaaatgaatttgattgtagcggcttggtctggtgggcttgtaaagagaatggtataaaatttgaaagaacaacagcacaggtcttatcgacaatgggacaaaaaataactaaagaacagctacaggctggagatatcatcacttttaaaacagatgcacgttatgttagccatgttggtatctatataggaaatggaaaaatggtacatgctcctaattctagaagtgtagtaagaatagatgatatattcaattcatcatattggacaaaagttacttacaattacaggaggctttattaatgaaagatttagggataaacaaagataaaaatatattaatttttgcgagtatctttgtatttgtagtagtagcttgtactatatacactgtatttttctcaaaagatagagaaaatatgactaaaattaatgatttgatatttaatgaaacagtatttgacgtaaaaaatacaagtaaatctggtactttagcagaaatagatctaactgaattatatatgataggtgtggataacaaatttgaaatattaattcaggatgagcaaaacgataagataaaatctaaaattaaagaaggcaatactagggaagaagaaacaggtggaatgatattagaaactgaatatgcagtagctttttcttatcctaaagataccgattatataaaggcaactataacaaaaggtaatgataaaaagagttttacaatagatattagagattttaaataaaaagagatatgattagattattgatttatccagattattataaggaagtgatgatgttgaaattaaataaaacaactgattatgcaataagggttgttgtatttttaagaaaacctggccaatggaaaacgaaaatagaaatctctgaagaaatgggaattccaagaaaatatttacaggccgttttagataagctacgtgaagcaggaatagttgattccaccagaggaataaacggcggttatacattaaaaaaagagtggtatgatataaaattaatagatataattaaaacaactgaagcagcagtaaacattaatacatttaatgatactgaggatataaatacaaagcagttaaaatcgtatttacctgtacaaagctattttgataaggttcagaatgagatagaagctaatttatctgtaactattcaggacattgtaaataattactaagatgatctattttatatagtaaaaatatttaatcttagatatacttgatacctctttggccatattatataatgtgtttagcaaggtagaactcaagccatggtaatcaaaaagggagcagggcaatgctccctttttataaaattctgacctattatatatgttcttttaaatgcaaataaatatgctttttagcaaggataaaaatttgtagcttatatgattttatccatcttgacaaattaaagtagtttggtataataatgatgcagatagttatactatcttatatagggtggtgagcccgagtgttggtttataaaattagggtggtgagcccgagtatactgaggaaggtcgctccttcctctatttttgtatgtacggagagaaaataaatatggataacaaaacagatcaagatcatgagataatagaaaaattaaaaacggatttaaaaaaagagaaagctcttaaagattttttctataaatcatttaattattattataagtggaatagagatggaaacagacttataaaatttttagatgagcagttatattcaatgtacaatcatcaaaaatgtaattttaaaagtgatgatcctttatataatcataattttaaagttggagaaatttttctcttccgttttggattaaatataatgcctgaaatgtcttttagtcatatgggtattgtaattgctaaaaatggcagctatttgtatgtcttaccaataatgtcatataaagaaagttatagtaatgcatatcatccagtaacaaataataaaaattatgatagaaattattatctaatgaaaagtgatgaatttgattttttagatcatgattcaattttgaaattaacagatttgagaactgtgtcaaagaaaagagcaataaaatttacaggacatagaataaatattaattctgaattttttaaaacgattacatatatggccaatcaggtacacttcccagatgtgttatatagaatagaagatgaaaatagaaaattaaaagcagaaatagtaagactaagaggacttagacataatactaaaacactaaatttagaggaggaggaagaacctatcaaataaatttcatatcttataaaagagtgctgtttgcgctcttttttgatattaaattatatatataaaagtatattatcttctttttattttaggaaaaacacaaattataataaaaagtatacatatataatattgatttttcctaaattataaaaatgtatgaatttgttaaaatacgaaaaaattttaaaattcacattgtattgtgacatttaatttgttataatctataataacaaaagaaaaaaagaaagaagtatgagtaccaatcatacctctttctcaaaacaaataagctttaccaacttatttgtttaatataaaagaattatctttatttccagtccaagataatccgttaagtgaagatatatccagtatcaacacttatttttataaataataacatttgacctaggtcatatgaagtaccagttcatagacaaagtccttaaatgttatatttataatatcattgtaattttaaattgtcaattgttacgtaagtaatttaaagcagtttttagtattttttgtagaaaacaagaagtagaatgataggattactatttaatcaggagctggagaagaaattcttcagctctttttgttttgtattttaataacaattgaatagtttacataggaaaattactttgcagaatagttgatccagcagctaggtaggtcaaatgacctacctagctacaaaacaaaatgtctaggtgtgtgtagccattgtaagaaaagtacacggggttatttaaagttgtcatgctttgttttgcccctaagttggatctcatgtaaatagaaaaccaacaataaaaaaagaatttagggaggcagttctaagaggaaaaatgtatggtaagtttggatagaacggaacaaaaacctatgttattaaataatgcagtataaatgtacgaatgccagcagtgcagagtagtacctgtataatttataataagtttgcatacatgtggattgaaatattcacgactgatggcgatctaagaaacctaagctccgttgcgacggaagtagagttaaagataacagtttttttgttttatagtacaacgggaaaaactgtatcaaatttcctatctcgaagctctggaagcaatattttataaagatcataattactttctattatctgttttatacttcatttttagtattaactatatattattttttatacatttattttcattttattggtaggtcatttgacctacttattatatgtagtttaaatatcgctttccatatctatattattaaaattatttttattattatttttgaaaaagtcgtgccacagtggcacactttttttaatagctcaattgtcgtttttcacgcattatatcagtgtttttcgtgagggtggtctaggctcgaggaccctagaccaccctcactcatcataacaaataagtttcacttatttattattaaacataatatattgcgtgttttcgtcatttgtccgataaactatgatgaaagtgtggcacggctttttttcttttcttatcaaggaaaggagaggggatgaaattgtacatattgtccaatcactccccatttcccctttccttaaaaaccataccccttaaccccctcaaggtgttttttctactctgtaaaaaaaactatttatttaaatttcttatcatgaattataagaaatagatttagttaatgcatcttgttatttgtcaataagcgaaaaataattttttactggacctgaaggccacaataaaaatttattttatcttgactgctgcacagtcattattgacaaaaacattttttgcttgtccgacttgctcggcaagtcaaacaaaaaagaaaataaaaatttccttttctgttttcctatgcactcccaattgtacgcaaaaaaccgcatattcaagtgatcgtgtttcacgatcacaatttagggtaaaggcagtcaccaaaaaagttataattgtgatagattgctaatttaccttttatgtattataatacaagtgcctgttggtgacattcattaatccgccaagattatccatgaatgtctttttttgtttctaaaaaaacattataaatttatactaaaaggtagacaatatacctattatatgatataatatatatagaaataaagaaaggggtactcaagggagtacaaaggttaaaaaaatgaatcaaaaattcttattgaaatggacggaaaaaggaccgatagtaattgagacgaaaagcaatattattagttatgaaactataaaaaatcatgttgctgatttggtagattatgtatcctatatagattttgggaatactaaatacgaaattatagtagatgatgaaggtatatgtaagaaactgccaattacttttattgtagtagacaaagtaaatttaaaaatctgctcaccgcttgctggaccttgcttaattgtaaaaagtgatagtgagggaaataatttaccattagagtttgaagatgtaataaaaatcatattacatgtaaaagaagtcgaaggaaaatactttatagagttggataatgaatatgttaataaaacaaatgagatgttgatgaaattctttacatctaagtgtgggtaggtcatttgacctacctacacaaagtatattatgatatataaagaagaaggtgaaaaagtgcaacacatttattagattatggatatgatagtaaaaaaacttgtctaatgatagttattaaaggtcaaaaaatagtataaaaatagaaggagtagaaaaatggacgctaaaaaaataaatatagatacttatcctacacttaataatgtatgcttagtacctaaagatactttaaaagaacttattgattattacaaagataatgaatatataaaacaacagttaaaagaagtagaggaaataaagcagggtaagagagcgagtagagatattgatgacgttataagtttattggagaaaaatggattataatgtataaaattattgtagatgaaacagcaacattgttctttctagaaaataagattaatgtatctaacactttaaaaaaagtaaaaaataaacttgaactttttcctagaagttatgaatcttataaaaatcatgataatataagagttattaaagtagaaaatttactgttgttatatataattgatgaaagtgaaaaaaagatttacattaaagatattattttttctaaatcaaaagtaacatttaaattgtaataaaggtaggtcaaatgacctaccttgttaataaggttcaacagcttgttatttgtcaataagcgaaaaataattttttactggacctgaaggccacaataaaaatttattttatcttgactgctgcacagtcattattgacaaaaacattttttgctgtccgacttgctcggcaagtcaaacaaaaaagaaaataaaatttccttttctgttttcctatgcactcccaattgtacgcaaaaaaccgcatattcaagtgatcgtgtttcacgatcacaatttagggtaaaggcagtcaccaaaaaagtaataattgtgatagattgctaatttaccttttatgtattataatacaagtgccttaagggtagatattcgtttctaatcttgccggattaacgaatgtcttcgatagttgtcagttcaacattaaactgtaattgttggactgattttttgtttctaaaaaaacagtataaattcatactaaaaggtagacaatatacctattatatgatataatatatatagaaataaagaaaggggtactcaagggagtacaaaggttaaaaaaatgaaaagaaaatattatgaagtaaatgaggggttagcaagaacggcaaaaagtatcaatagttttagtgattatgtagaaaatacagcaactcatgaatacaaatattattgcgataaagtatatgatgttcttgaaaaaattattgaacagaaacctaatttggctgaaaaagcaacttataaagtagatagatattgtagaaagttggcagattattacaatgcttattacaaaaatgaagcttcatgtccctcaattttaattacgggtgctggtaattttccaataaaaaagaaaaacgttcaaaataagagaagggaaaaattacatgagacatggaaatatttagaacaacaatcggaacaaataaaaaatttgttaattatggatcaaccgattttatcaaaaaatcaagatgcagttgagctattggaagaaaaaattgctaagttagaagaagaacataaacaaaaattatactggaataaatactataagaaaaatggtactttaaaaggtgctgaaggactgggtgacaaacaaattgaaatagttgaagattttgttagaagaaatccttcttttgcaccgtttagtgttgctaatgatacagccaatataagaaggtataagcagagattagaaaaaatgaaggtggccaaagcaactggaacaaaaattgaggctattaatgatgaaaataataacgaactattcaaagtagtaaaaaatactgaacttatgcgacttcaattgatttttacggataagcccaatgatgaagttagaactattttaaagaagaatagttttagatggtcaccaaaaaataatgcatggcagaggcagttaacagaaaatggaatgtttgcattaaaaagggtagtaaatgaaattaataagctaagcaagcagtgttaaatataaaggtaggtcatttgacctaccttgttaataaggttcaacagcttgttatttgtcaataagcgaaaaataattttttactggacctgaaggccacaataaaaatttattttatcttgactgctgcacagtcattattgacaaaaacattttttgcttgtccgacttgctcggcaagtcaaacaaaaaagaaaataaaaatttccttttctgttttcctatgcactcccaattgtacgcaaaaaaccgcatattcaagtgatcgtgaaacacgatcacaatttaaggtaaaggcagtcaccaaaaaagaattggagtaaactacattattttttattgtatagattaatataattataatatgtacgttttccaattcctacttcatggcaagcattggttacattgcttccattattaactaatgtaatcactttatctactttgtctttaacgtcaggacgaccaaacttaacaccacgctttttagctgattcaatgccctctctttgcctttctaatgttgttattctctcttgttcagctacagaactcagaacctccagtattatattattaatcatttcaataacccattgttgcccgtctagttcaattagtgtagtaggcatatttaaaattcttaaaatgacacctttttctttgaaataattgaattctcttattgtatctctcttatttctagaaagtctatccaatgcatgaatatatactatatcaccagctactaccaattcttttagtttttgataattttttctgttggtatttttgccacttagtttatcactgtaaatattttttatatcaacgtattttgttaaactatcgatttgtctgtctaatttttgttcttttgtagatatacgagcataaccatagatcatattactcaccatcgttattaagaactactgatctagcagctttattgagtccatattttggttttaagattatttcatagtctaaagcatccattattttaattaaactctcagtattaggattatttgttcttagtattgtatttaaacttgttggatttgtatagttcaacttttgactaagatctttttgagtcatatgttcttgatttaaaattttttttattgcttgttgtgctttcatattattcacctcaaatattattatattttacagtaacgattgattccaatagaaatattataaattcttaattttaaacagtgtataaaagtggtctttattgcacttttagataatacgcattaaacagtatttaataaaaaaattatacttataaagactaaataatcaactattaaaaaaaatacgtatttataagtgtttgatattaaatttaatgataatttgctaatttaccttttatgtattataatacaagtgcctgatggtgacattcaaactaatcttggtcggttgttgaatgtctttttttgtttctaaataagtcttataaatttacattaaaaggtagacaatacaccttttgtgtgatataataagtatagaaataaagaaaggggtactcaagggagtacaaaggttaaaaaaatggataaaataattgataagattaaaaagctgatggcaatcgctgaggatcctggggctagtgatcaggaaattcaactggctacttatagagcaaataagcttatgattaaacataaaattacagaacttgaattaaatgaagataataatggtgacattattcaaaaaacaatgaatcatgggtaccataaatcaggtacccttttagttggaatgatatactgttattatcagacgaatccaaattcctatagaataaaaaagacttttgtttcaccaaaagtctaaatattattgataaagtttttatttcctttgatatttaccatatcgaaaaaagatatatctatatgccgccagtatcttttgaggaacttcaacatgttcaatatactgcttaccatttggtccatagccatctttatcatcgatgactctcttcatttctcctaataaaagtgaaatatatcgttcttttgaccataagccccaaatattatttttaagttcaaatccaatattctcaacaactggcaaaaaacatctataattatcaaaatttatatgtggagcataatgtcttgcagttgcatcgattcgcctttgcataagaggatcatgaaccaataaaatattttttactataatgtcttcttttttgagaagtttgaaagcaaactgaatattttccccacaattagtagattctttttctaataaaatagtattgtctaccccataattttcttcaataagatacttaaataattctgcttcacttcttttagtaatatctttaatatcatacttctctttaatcgtattgattaaaatatctgtagtatgaccttttcctccagcaatcatgaagtgataagcatgccctgttttgtatagttgataagctattaatccagtttcagcaatagcatttcctaatactaaaatcagatcatactttttcttttcatcatatgtatttatcgctaaaaactgattaagaagattaaaagcctgactatctttcatttaattgcaaatattgaggaagctcaatttgtccacttttatatattaaaggaaccacataatcaatatattcttttttaatcttcttattcttttcatcaatccattctaatggaaatggtttaacatgatttgctactttatgaatatcaacgtgacttaataaaaattcatttctattttttgaaattgtgaccataatccccgttcgtttatccaacgcacaatttattgcataactaccaatacgtaaagcattttctatgtctatgtaactggctaaatgtgctgcacaacgctgaagggtacttaactgaatggcccgtactttacagccaagatggtcaccgataagtttttttagataatttgaacagccattatttgataaatgaccaaatgcatctttttgaatcccactatctagtgatacacacattccatattgatctcgaataccttcagatacagcaataatacagtgatccttcttttttaatttatctttgatctgttcaagaaagtcattttcatcaaaaatgttttccggcatataaattaaatcgatagaatcaggatagacttcattaacaagttgtgctgaagctgttaaccagccagcatctcgccccataatttctacgatcgttactgattttattggatatataacactgtcaaaagcaatttcacataatgaggtagcaacataatgacaggcagaagggtatcctggtgtataatcaatattcataagatcattgtcaattgttttaggaataccaataaagttgattgggcaattacatatttttgcataagtacttaatttttcaatagtatccattgaatcattaccaccaatataaaagaagtcagtaatttcatacttatttaatattgtaattattctttgcttaattgattgatccttttcgaaaatcttatatctacatgagcctaaatacattgctggtgtatgaatcaacttaaacaaattcttctgatctttaaaactacttaaatcaaccatcttttcatctagcaatccatctattccattaatcattccatatattttctcataatctgctttcaaagctccttgaatgaccccggctaatgttgcattaataactactgtcggcccaccagattgtccgattatacattttctcgacatgatcttcatccccttatcttctttaaatattttctaattcctcaccatttgattgaataacttttttataccagttaaatgattttttctttgatctttttaatgttccctttccttcatcatctcgatcaacatatataaacccataacgttttgtcatttgaccttcagttgctgaaattacatctattgggccccaggttaagtaacccatcaaatcaattccatcatctagtgctagttttacttgttcaatatgtgcttttaaatattctattctataatcatctttaattgagccatctgtttctacaacatcaggtgctcctaaaccattttcaacaataaataatggtttatgaaatctttcttgtaagaaattcaatgtaattcttattccttgaggatcaatgatccatccccattgtgatgcatcacaataaggattttgtaacttgccatagttattgatctttaatctgtgatctgtcgttactactttacttgcataataactgaaagcaacaaagtcaactgtattattttttagaatctcctcatcatctttttccatatgtatagtgattccttcttttttcattttagctttcatatgatatggatattctccaaaaacttgaacatctgtcaacattagttccttattattttcctcaaaagcttttaatacatctgatgggtgacaagtatacggatagactaccccacctgcaatcatacatccaacttgattatttttatcaatctcatgtcctatttttgttgctaatgctgaagcgagtaactgatgatgcattgcctgatacttaatttgttcaatattatcaccttttctatataataaacctagggttgaatagggctgaaataaaccaacattaatttcacaaaaagttaaccattttgttacctttcctttataacgggtcattaacagacggactagtcggcagtagaaatcgatcatttttcgattagcccagccaccataatgctttgctaaatacaacggtacattaaaatgattaagtgttattaaaggttgaattccatgtttaagtaattcatctattaaactatcatagtatgttaggcctttttcatttggttgttcttcatctccatacggaaataaacgcgtccagttaactgacaaacgtaaacatttgaaacccatctctccaaacaaagcaatatcctctttgtaacgatggtaaaaatcgattgcaattctatttggacaatactcaatattttcattcatataatcaagtggtgaagcatatgctgcctgccttgcttctaatccgcccggaattacatccattaaatctagacctcttccatctgcatcaaaagcaccttcgcattgattagctgctaaactgccaccccataaaaaatcatctttaaactttgtcatttttattcctccactgtttctaatacagactttactaggtaatctgcatcaatcttatatttactcattaattcctctggtgttccactttcaccaaatgtatcttggatagcaattggatatatctttttaggcttatccaacttctcacaaactaaactatacaaaccacctataatattgtgttcttccaatgtaaagataagatcataactatttataattgaatttagttgcatcgtatttattggtttaagtgaggacacattgtataatgacgggtatatattatttttagctaaaatttcaatagctttcctagcctcatttaccataataccagtcgctaaaaaagcaattttacaacctttaacaattggaacgatttcgcctaaaagaaatttataattagagtccaaaatattatccactgcatatctgctcgttcttaaatatacaggaccatcatagtcaaccataaactgcatcatagcttttgtttcatttgcgtcacacggttgcaaaactaccatgcccggcaaaactcgcattaaagcaatatcttcattacattgatgagttgctccatcttcgccaacagtcaagccggcatgagttgcacaaagttttacatttaaatgtgggtaagcaatagaatttctaatttgttcaaaagcacgccctgctaaaaacatggcaaatgaacttacaaaaggctttaacccctgaaccgccaaacctgcacctattccgaccatatttgcttcagcaattcctgtgctataaaattgctgtggtcttgcttccttagcataacatgtttttgttgcgggcgataaatccgcatccaaaacaataacatcgttattttttatcactagctcttttagtgcttctccaaaggcctctcttgttgcaatcttcatcctaatgacctcctaactccctcagagcttgttccatttctttacgatttggagcctttccatgccattcaatctcattttccataaatgaaattccttttccttttactgtatgagcaatgattgcagtaggtttttgactattttttgccatctccacagctgcttcaatttcatcaaaatcatgaccgtttatattgataacttcaaaaccaaaagctaagaacttttccaagaaaggttgtggcccaataacatcgactatttttccatcaatttgtaatccattatagtcaagaaaaagaataaaatgactaagttgataatgacttgctgccattagagcctcatatacttgtccctcctcaaattctccatcaccacaaattacataagtataataattattatttttgtacttatttgccaaagtgattccaacagctgcacttatcccctgccctaatgatcccgttgacatatctacacctttcgtatcattcatatttggatgcccctgtaaagaagaattaatttttctaaaagtcattaactctttttcatctaacactttcatttcttttaatacagcatataaagctggtgccccatgacctttagatagtaccagcttatttctttcattagaattaatattatctttagttagctttaattccttttggtacaagtacattaaaatatcaatacaagataaagatccacctggatgtccagatttagcttcatatatcattttaataatactttttctagcttcattagcctttttatttaacatcgtttacaccgcccccttctcttcttagcttttgtaaacacttttgattagctagtctaaccctaacacaacagatactgatctatatccaactcccatacgatcaattcccatatcaatcaattgtaaaaaatgttctcttgttcgaatacatccacttcctttaatcttaattttatcaccacattcttccatcattactttgattatttccaaactcgctccatgagcttcatgtcccgttaaaaatccagtacttgttttaacaaaatcagcacccgcttctatacaaatatgacacatttttcttatttgtaactcatttaaagcatcagtctcaaaaataactttaatttctcttccatatttatgggccgcttcggtacaggctttaatatccgctaaaacttcttcccactttccacttttgatcattccaaagttagcgactatatcaatttctttaaccgaatcgtatttagccacaatttcaatttgtttaactttagattctgttgagcttgttccaaatggaaaatcacatactggacatagcattgtgtctgttcctttaacataaggctcacataaatccatataaccaggattaatgcaaatagttgcacaatttaactttactccatcttttgttagatcgataatttcctgttcagtaaattctggttttaaaactgaatagtcaatataagatgctaactcctttaaattcatttcatttgccttttttgttatttttttcatttttctaatagataactatttatttttgtttgtttttgttcgttatctttcctccttaattaaaaaataacacataaacaaacatttgtaaacatatatttgtttatttttgttcgtttttgtttttttgtataaaaaaacatatcaaacaaactagttcaatatgtctttatttaatcttcatttgttaaaatataatttactggaatatcatcaatattcatatgagcatccttattacagataactgcatcaaaatcatcactgctaataaagctacaaaaacctttaacacttaactttgatgaatcaattaataaatacttctttactgctaagtccattgctttttgttttactgccattgtatccatttcagctgtatagactaattttctatctatatctatcccggcacaacttaagaaagcataatcaaaattaaacttttctaagtcacttaaagtaattggaccaactgacatattgtattctggaatatatttaccaccaatcataaataattcagattcaaaatcattaaatccatttgcaatcaaggtactatgtgttactattttaacattttttccttttatatattttagcatcggtacaatacttgttccaccatctaaaaatatacaatctccatccctgataaatgatgctgcttttttacatactaaatctttctctttattattagtaattctttcgctcatttgtttttcatctttatttgaaagaattgttttttgctcaatactttttgctccgccatgaacccttatcagcagtccttgtttttcaagttcttcacaatctcttcttatcgttgtttctgttacatctaagttttcagaaagttcttttgttgaaataaacccacgttcattaactgtatttactattcttaaaaacctctcacttgcaatcatcatactcacctcttcttttcattatacttaaatgccatttttattcaattattttaaaaagataatctttttcattatataattactttttataaaattatatgatttgttaactataactttaaacaatatctaagatttgctaaatcaaactgttctataaataaaccttgatttaatcaaggtttattagtcaaaattattcaccaacgtatgataacacttattttattgatttttaatggtttctcatccataaatcactatatttacacctattatttctatttaaaagattttttgatgtcaaatcttttagaaaaaaagaaaaacccttgaattcatcaagggtttaaatttcaattattcaccaacgtatggtaataaagccatttgacgagcacgtttgatagctgtagctaacattctttgatatttagcgctagtaccagttacacgtcttgggataattttcccgttagctgaaacgaatctttttaataattcaacatctttgtaatcgatgtaagtaattttgtttttagtgaagtagcaaactttttttctacccattctttgttttctaaatgccattttgaaaactcctttctttaaaactgaatatcatcttccatgatatcatatgtattaattgaattatcaaattctttttctaattcaactgttttcatatcatagaaattatcattattttgtggttgttggtacggttgttgcatttgttgttgtggctgtggttgcctttcacgagcagctcttgtttctaagaattgcacactatcacaaataacttctacaacatataccttttgaccttgagtattgtcatagctacgtgtttggattcttccttcaacaccaactaaacttcccttagaacaatatctctcaacattttcagcaggtttacgccacacaacacaattaataaaatctgcttgttgttgaccatctctgcttgtaaaattacgatttaccgctaaagtaaaagaagtaaccgcatcaccttgtggtgttcttctaagttcaggatctctagtcattcgtcctactaggactactctattaatcatctagtacgcctccttctatttgcgaagagttaaatgacgtaacatagatgcattgatgtttgataatcgttcaaattcagcaacatcagcagctgtacaagtagcatcaacaactacatagtacccttttttgtaatctttgatttcataagctaaatcgcgtaatccccattcgtcaacgttatcaacagttccaccgttagcagttaaaattcctttaaagctttcgattaaagcgtttctagcgtcatcttcaacgtcaggttttacaataaacataatttcatacttgttcatttctatacctcctatggtctattggcttatctctttggataagcaggcagtaaatataatatttttacatgctcaattataatagcacaccaatcaaaacaaagcaatgatttatttgattaaatcatcatattttacagtatccctaactgacttttccaagttaagattcgcattacagaacgatccaacgaattgagacatatttcatcattcttagctgctgtaataagtgccgagatatgttcttgaggattagaagtcataattaaatcattccctgccttaatcgctttaagcgcaacttcaccttcacttccaaaggcttttgcactagccattgaaatatcatcagcaataataacgccatgataatttaagtcatctcgtaaaatcttactcactctaggtgacaatgatgctagattttgatcatcaatactatcaactactatgtgactaatcaaaatactatttgcacctgcagatattccagctttaaatggtaagaaatcattattgacaagcgaatcataatcacgtgaatcatggcatatagcagtatgattatcagcaacgttcccatatccgggaaaatgttttaaaacacttcccatcttaatatcattcattgcctttacgacatttttcacaaattcagctgtttcattaggatcagttccaaatgaacgttgataaataaaatcatctttactcattgcaacatcagctaccggacctatatttacattaattccaaattcttttaaaaactccgacttttctgtagcatcactaataatagcgtccatcccgcctgctttaaaaacatcttggggagaacgaaatttgttactacgtaaattattactaacccgtactacagttccgccctcttcatctactgcaatcaacatcgggatagtaactgctttttgatatgactgaatattttcaattacttcctcacgggtccgattatgaaaatcacgattatataacatatagccacctaattgatattgtgacaacaactcaactgcttgactttcaggacaccgagctaaaaataattgtgctattttctgctctaacgtcatcttttcaaccattactgcaatcttatgcgaagctatcgtagcatccgtattaccagttccaccatttctaacttgaaccgcttgaacatttaagcctaaaacatcaattgcttgtatcgcggttgtttgctcgagtttacccgtatatttgatagttactaagttcccatactgtaactcatcaccttttattttggccttttgacaatccaccgtataaacaatattattatcatcacgcaaactgattgtttcatgtgttatatcaactatctgtccctttaactctttagctgttatcgtagtttcgccttcccctgctaagcgcaactgataaactaacgcccccatgatcaatcctaataaaacaatgattataatgattttatgagtaataaaattattatttctttccttcatttaaagatcctcaggagtagttattttaatattctcataactgcctattacaactttgactggagctgtactaaactcttcaaccaatgaggcatcatcagtagcaataaacccactatcttgagcctgttgataacaaactttaattaaactcgttttaaaggcttgcggagtttgagcttgcatcaatcttgccctcggcaaagtcacctcaacagtatcatcacaacaaagtttgatcgtatctttaactggtaccatcaataaacaggcatcatattcttttaaacataataataaatcatctattttttctgtcgttatatatggtctagctccatcatggattaatacatgatcctggtcaactacctgcaggccattataaacactatcttgacgctctttacctccataaacataaacaattctcttatctgtcactaactgttttaaatcagttatctcatccgcttttgtaactacaacaagctgcttacagcgcggatcatttaaaaaagttttcatcgtcatttgatacacagtttgatcaccaaaacgatataacattttattataatccagtccactccggcttccttttccagcacataaaataatcgcactataattcatcaatctcacatcctttcactcattgtaacatttaatgattatcttgaaaacaaacattatttatcgatttattaatataattagtaataataagggagtgattttattactaaaaatataattggttttattgctagtctcggtgtttttctttatagtatgcatctaatgtcaactagccttgataccttagcaaacgataagcttgaaaatattttatataaactatcttcaaataaatatttaggtgttatcaccggaacagccatcacagcaataattcatagttcctctgctacaactattattctcatcggtctccttaatagtcatctaatttcattaaatcaagcaacttggattattttaggtgctaatatcggaactactgtaactggactcatgattgctttagatttaggtcagtcagcaatctatttatgtgtccttggattattactaatgttcttaaaaaataaaattgcttatttaggacgtgtcttaatggccctaggattgatttttttagcaatggacagtatggccgtagctctggcaccattacaaacatccccatattttattaatatgtttggtcatttagacaatcctttaaccgctattttagttggaacagtttttacggcgttgattcaaagctcaactgcatcagttggcgtcttgcaaactatttatcaaaagggattaattagttttgcaatggctaccaatgttatttatggtcaaaatattggcacttgtataaccgcagttttagcatcacttaatggcgatcgcagttcaaaacgtttaagtgctattcatatcttaattaatgtactcggaactattatttttgtaatcttagcaaaatttatcccactagtttcattcatcgaatccttgactccaaattatatgatgcaaattgcttatatgcatactttctttaatatcatttcaactattattctattaccatttgataacttattgatctatctggctaataaagtaatcccattatcaaaacaggaggtcacttatgctcacaaaccttctcgcttatattaacacctacggctacaaggcaatctttcttttaattgcgattgaaaatttatttccgcctatcccatgtgaaataattttaacttttggcggtttcatgacaacgatcacaaacctaacacctctaggcgtaattacagttgcttcgcttggttcttatttaggcgcagtgattctatattggtttggctacttaatcaatctagaacgactcgaaaagcttctagtccgattttattttaaacgtcatgatctatcccgttcccttaactggtttgaacaatatggaaaaatctctgttcttattggtcgcttgattccgattgttagatcattgatttctctgcctgccggaattactaaaatgaacttctttagtttctcattttatactttgattggtacaatcatttggaatagtattttagtagttcttggaattattttaggaaataactggatcttaattagtaaatatgttaaacaatacgcactgattattgcaatcatcacactattaattattttatggaaaaagcgaagactcaattaactttgggccttcgctttattttgaaaatatttattagctgctttaacaattcctcttccttgaagtttcatatcatattcctttaaaatcaactcaatatcttcttctttaacctcatgaggacaatttttacgaataattttctttaaatccatttttgttaaattcttaaaattaattatttcatcgatacggcttaataattcatcactaaaaaaattcttaactttactactatgattattctttttaaatcctaatgtatttttagcagtccctttatttgacgtcataataataattgtattattaaaatatacttttcgtttatgactatcttctaaataaccttcatcaaatacttgaagaaaaagatttataacatcttgacttgctttatcaatttcatctaaaagaataatacttttaggataggtttgtaattgtcccagtaataaacttggtttatcataaccaacatatcccggggctgctccaattatcttttgaacactgctgctatcacgatattcactcatatctaagcgaatcaatttacgccccaaaagttttgaaagctgttttgcactttcactttttccaacaccactatttccaacaaataacattactgcacttggttgttttgactgttttgttaattttaattgattgattatttgttcaatcgctttactttgtccaataatatgatgattcaattttgctttaatttcatcataatcataatcctcacttatcttaactgatgtatattcttctataacatctttaacaatttgtttagtaataatatgttgctgcttaaatcgggctttaacacaagctaaatcaaaaatatcgatggctttatcagggaaagttcgatttttgatataacgatcaacattatcaactaaatatgttaaaacttcattatcgacttcaatctgatgaaattgctcataaaataatttagttttctgtaaaatttctaatgtttcttctttagtattttcttttagtgtaataacactaaaacgtcgattcattgcttgatccttttcaaaatgctggaaatattcttctgtcgttgttgcaccaataatcgttagatcttttctcgctaaatacggttttaaaatattagcagcatcaatagccccttcggcgccaccagccccaataatattatggatctcatcaataaaaatgatgacattatccatttcctttaccttatcaataatctttcgtagcttttcttcaaattcaccacgatattttgttcctgcaacaatactagataagctcaattcataaataattttcttttttaatccttcatttacttgtttttgattaattaaatacgctaatttttctactaaagctgacttacctacaccagcttcaccaataatcaacgcattatttttttctttcttacttaaaatcatacataatttttctaattctttttgtctaccaacaattaaatgttcaccctgttttactttcttattaagattaactagtgattgaatctgatctaatttagtttctaattcactactttcatttaattgatagataatttcttcaaaatcaactttatatttctttaataattcgtgagctacactttcttcactctgcaataaagcaattgttaggatattaagcgttactttacttttattttgttgattagtgatttccattgctgcttctaagatactttttacagcatcactatactccatataaaaaggttgatcatcatttgtcccaaacaacctttttatatcctcatatatatttttatcatcaacatcatatttcttaactaattcccgtaatttggaatcacttatctttaacagcgatagcagtaaatgttcactaccgacattattatgacctaaatcaaaagcaatactttcgcctaccacaattgctttttgggcttgttcatcaaattttgttaacatgttccacctctaattttattatatgtttgacctcttaaattattaacgaaacgatttattttaaacataaaacagttccctttcgagaactgtttagagttgatatatagatattctgtttcgaccattatttttacttaaatatagtgctttatcggcattagaccacaactcttgataatttttaccatgtttaggataatatgctcccccgatacttaaagtaattgtgctgcttctatcaattgttgtaatattcttctgccaattttgtttaaattctttaatagtcttttcaattgcatcataattagcatcgtctaaagccagataaatgataaattcatcaccgccaatgcgaccacaaattcctgatttaaaactttcttgcattgtattagctaattttatcaaaacctcgtcaccatacggatgaccattattatcattaacttctttaaaataatctatgtctaatactaagatcactccatactgatgattactcatcgcttcagtaacttctttttcaagtgatggacgatttaatattccagtaagataatcatgtcttaaattatagattacttgttgattggacatctctaattccttcgtcttttcagcaatttccttttttaactgagcattactttcttcgacaatccgttgtgggaaaaactcatcatcaccttgactataatccggtactgattgatgaacatggataatcttccactgcatatcatgatattcaataataaaggttactcgtgatgaaaaactatagactaactggtcgttactattttgtcggccctcaatttggccaattactacaaataagttatcagctaattcagttccctgataccattcatcttcaattataaaagttccatcccaaagttctgcttctttattcaaagccgtcataagttcttgaatgttgcgactaacctcgtgagctcccgtcccaatgattgtaatccttttatcaattatatcttctaataacttataattacgcttcccaagatactcatgggctatatattgacaaaagatttcagcatcttttactgttttcatctctgactcctttcattactactctattaaatagtatagcatatttcagttatatttaggacataataaaagactatcagtaaagtgagttccaaaagttggatataaccaactagaaggattcgcttcactgataatcttaagaaaataattctgcaaaaaatgatttctttttaatttctttactacttacacaataacttgccttcaaagtacccgtaagttcctttcctttgccagcgcctaggacaattgtatattctccattataatacttagcttgataatctttttgatgatcagctagtgcttgatcaacatcatcaacacttttaatccaatctttatagtctttaattaagtcatcttttgtttcatacattgtcttaatatctttatcactattactattggcaattattttatattttgggtcattacttgaagcatttactgatacaatattcatcataattaataatactacaattgtttttttcatctagttcacctcaagttcattattaccaactatgattaagttatacaaaaaatatttaataaaggggtattttatgactaatcgaattatgcaaaaggaaattgtcagtgatccttttaccgcactagttcctaatacagatataactgacactttacaagaatttatggcgctgcaacaactttatgatgcgggaattaaagaagtaagaacaaaattagaaattcttgatgatgagtttaaaataaaacatgatcataatcctattcatcatatggaatatcgtttaaaatctgtaaacagtatattgggaaaactagaaaaacggggcctagaagtatctttagattctattgtaactaatttgactgatattgctggtgttcgcgttatttgtaattatgttagcgatgtctataaaattgctgatttattaataaaacaaagtgatattaaacttattgccaaaaaagattacattaaacatcccaaggagaatggttatcgtagtttacatctagttgttgaagttcctatcttcttagcagagaaagttcagccaactactgtagaaattcaaattagaacgattgcgatggacttttgggcaagtttagaacatcacttgcgatataaagctgataatgaagttcctgatggagttcgtgatgagctaattgaatgtgctaaaacaatttctaatctggattataaaatgcaaggtatccatgaggaattaaataaaccaaagaaaaaagtgatttagtgtagtattcccaaaaagttggacacattaaattaaagctaaatcttgaaaggattgttgtctatatgcaagtggactcaatccttttctttttgtattgattctctcgttattataatattcgatatattcactcattgcagctttgagttgttctcttgttttaaactctattaatcaattcgattctttgttcaacagatatggttgctcttccatgttctaatcctatttctccaagtgaatcaaatatcctagaccagcgaagaacttaattataaaaacttcatgtttaattcctggtggtccttttatgcattcaccattttttatgtttttaaatacattctaatttaagttctttactctacttcatataaaaagtgacctcctaaagttggtcactacatagattactttttctctatattaatttaaactgtccttttaaaatatcttattattggttattaagatatggtcaatattttgctattatattatcaattctaaagggggattagaaatgattaatgaaaaaacaaatcaactcgcaaaaacagcactaatgatagccctaatttttgttggaacattcagtattagaattcccaatccagctactggaggatactttcatatgggcgacagtatgatctttttaagtgtattgattctaggtaaaagagatggtgcctttgctggtgcattaggaggtgctttagccgatttactatgtggtgcagctatctggatcggaccaactttaattattaaattcattatggcctggatcatgggaattatttgggaacagtatccaagtaaaataataagtgcaattggtggtggcgttttccaaattatagcttatacagcaactgaaacttttttatttacttggcccgctgcacttggagctttacctggtctaactatgcagactgctggtggcattattatttatgttatcttagcaagagctttacagacaacaaaattattaaacagtgattaaagagttactgcatttcagcaattttttataaatttattttattaattgcaatatagttgataaagttttctgcagctgctgaaatataatctactttattataaactagatagattacacggtaatctttttttaattttaaaggaatgacctttaaatcaaattcttttaaaaatgatgtattagcagcgattcctacaccaaacccttgattgatcatcccaccaatcaataattcattttcctgtttagaaatatagcggggctccaatttatgttctgcaaaaatttctttaactgtttgagcaattactaaatcatcaagatagcctactaaatcatagtttactaattcttctaaacttatctcctgcttatttgcaagttcgtgatctggtggaacaacagcaacaaattcctgatataaaacaggaataaaaactaattctggagcaattatttttccacaaaaacctatatcatatttatgttcttttagccctttaataatattttctgttttatcagtttgaattttaaactctgtttggggatattgctggagataacctctgattgtatctggaatatattgtgatgatagtgtatgaattattcctaattcaatcggctctctatctggacctcagatagctgctaattttgttaacagtgaagccggcccccttgcctataacaatgtctatttagttgctattggtgttgcaatcatcggtcttatcttaaatacttatttaatcaaaaaaactgcttaggagatgaaaaaatggaatatattaacatcaaaggtttagacaaaccgatttcaaaattaattatgggtacagcctggtttaatccagcctttgaagaagaaatttttacaatgctggatcaatatgttgctgctggaggaacagtaatcgacacaggtagattttatggggcaaacaaagatggagaacatgcttgtgaatctgaacgagttttaaaaaaatggtttgattctcgtaataatcgtgatcaattagtaattatggataaagcatgtcacccaattattacccctgaaggctgccatcatccagagtattggcgagtaaagccagatattattactgacgatcttcattatagtttacttcatacagggtgcgatcattttgatatttacttacttcatcgcgatgatcctagtgtccctgtcaatgaaataatggatcgtttagaacagcatcgtcaagaaggtttaattactacttatggtgtatcccattgggaactagatcgtgttcaagcggcagtagaatattgccaacaaatgggctaaagaattaggaaaactcaaaggggttccttcaatcaatattgcccttgcatatgtacttgaccagccatttgatgttgcagctattgttggtagtcgtaataaaagtgaatttgattcatgtgctgaggcgttaaaaataagattaactcctgctgaaattgattatctatgtcttaaaacagacaaattataaattaataaaagccatagcagttatggcttttattaattgtttttactttacaaatactatataatttaattacggtaactattaaggagatgattttgtccggcgcacttgatgttacataatcagtaacataagtgaaacgtggaaaacttagataatcaaaaatgcataattttttacctgtcaaaaacaggttttattgttatgcccaaatgattattttaatttccacattaatagtcaaaactcttaactgtggaaataaccacagttttttattttatctagttaccggatcatacgaaagcacaaaacacgatgaaagacatattaaaacaattaaatacgcgacctaaattatttgaacaaagtacagcaagtatttgggacgaccctcatatttcaaaaggcatgttaaaagctcatcttaacgagaaccaagaatcagctacccgtaaacttgactttgtaaaaaaatcagttgcctggatcaatactgtactacctaatcatcattataacaacttacttgatcttggttgtggccccggtatttatgctgaattattctatcagtatggttatcaggttactggtatcgatctatcaaaacggtcaatcagttatgctcaggcttccgccaaacaaaaaggatttgatattatttaccttcgtagtgactataccaaatcgaactttagacagcactatgatttagttactttaatttattgtgattttggtgtccttcctcctgctactaggaaaaagctcttgcaaaagctctataacacattatcccccaaaggcgctttattatttgatgtctttactcctttacaatatgatggagcggtagaacataaaaattggcaaataaatgaaaatggtttttggcataatgactggcacttagttttaaatgctttttatcgttatgataatgtccatacatttttaaatcagtatactgtcattaacgaagatagaataactacttataatatctgggaacatactttttccctgaaagaattagagagagacttaaaaaatgccggctttactaaacttgatttttataaagatgtcattggacaaaaatatgataaaacaagtaaaactatttgtgtaattgcccaaaaataagactaaataaaaatgactccttaaaaagtcattttttattaataattcttattcagataaaacattggttttgctttttcattaacttcaaaaccaagatgttcataaaaaccaacagcagtatttacaccaatcaaacaaactttatgatagtccttataatgttccagcatcatttgcatcagttttttaccaattccatatttttgatattgtggattgactaaaacataatgaacataagcaaccatgatactatcgtccatcgaagcaaccagaccaacacacttatcattatcccaagcgctaaaaacacttccatagttttttattgcctgtactaattgagcaggatagttcgctgactcccactctaccgatttaaataaatcaactaatctctcttgcgaaatctctttaatattcttataggttaattccataaattcctccatctatgtttaaagcggcatatgccgctttaattaatattttgaatcaatgtcgtaataaactaaatcatcaaatgtctggcgacgaatcacttcacgatccttaccttcatacgtaaataccactgccggttttggcaattgattataatttgatgacattgaataatgatacgctcctgttgaaaacattgccagaatatctccgggctctgggtcttgtaacataatatccttaattaaaatatccccagattcacagttctttccagcaacagtaattaggtgatccgtcggcatttctgctttatttgcaataatagcatcatatttagcagcatataagctagaacgaatattatcagtcatcccaccatcaactgtaatataatcacgaatatctttaatatatttagatgacccgacggtatataatgtgattccagcatttcctacacaataacgaccaggctcaactaggaccatcggacgttttaatccccgagcatcaaatcctttagtaatgatttccatgatcgtatcaactactgtttcaaattctaatgggttatcagcagctgtataagcaattccaaaaccaccacctgcatttaatttattaattacaattccaaaaatatcataaatttcataagcaatttcaacaaatttattcattgctaaaacatacgcttgaatatcttcaatttggctgccaacatgacaatgtattccatcaaaattaatatttggagcatcaattacctttttgattgcttttagatatgtattatcatggctgctaaaaccaaattttgtatctttggcaccaactcgaatatagtcatgacctcctgcataaacccccggtgtgattctgacaatcccatttattttgacacctaatctcgaagcaatttcttggactaaatctatttcataaaaattatctattacaaaattttctaccccgttttctaacgcgtattctatttctgatggtaatttattatttccatggaaataaatctttttaggatcaaatccactttttaaagcaactgaaatctcacccgctgatacacaatcgattccaacaccatattctttagcaattttataaattgcaatacaagaaaatgattttgatgcaaataatggtagtgtattttcatacttttcaatcattttcgtttttaatttattaaattgatgtctaatatgtccttcagacataacatataaaggtgttccatatttttttgctaactctgttgctttaacatcatctatgtataagttattatttttaatttgtgcaaattccgtttgtaagaccatattttccccctattaatataatgattttaaagtaaataaaccattatctttatcatttagtgcataagcagcactaatcgcaccttgaacaaatacttcttttgataaagccgtatgcttgatttcaataatttcatctactcccgcaaacataatcgtgtgttccccaaaaattgttcccccacgcaatgactggatcccaatttcttctttctttcgtttttcatgacgactgctgcgatcataacacgcttctacgccatcaatttcctcagccataacttcatataataattcagcagttcctgaaggtgcatcaattttctgattatgatgtttttcaaggatctcaatatcatatcctgcgtcataaaattcttttgcgaattgtcgtaacatttttgtaaccatctgcaccccaaatgatgtgttatatgattgaaagatagcaatttctttagatgcttctttaatttgatcaagctgttcttgactataacctgtcgtagcaattactaattttgtttgattcgctaatgcatacgttaaaatatcatttaaattgttcggatgagaaaagtcgatgatgacatcggctttttcatcgcactcttttaatgaactatatgttttttcaggaactttttcatcaaattcataacttacaattcccattaattccatatcattttgacttcttactttatgggcaatctttttccccattaatccatatccatatactaatactttcatcttaaaaccccaacttttcaaatgcatccatcgcatcaaacaataattttttattttcttcggttgtttcaatcaaaggcaatctcaatgtcggtttacatacattcattcttgctaatgcagctttaggcataattggattaacatcaatgaacaaatagcgacataccggctcaagagcataggccaattcttgagctttaggtaaatcaccttttaatgctaattgagccaacaattcagtttggcgtggataaatatttgataatactgaaataactccttttcctccggcacaaataaatggcaagatattatcatcacatcctgaatacatatcaaaatccataccttgagttttagctaaaacttccattgcatatgcaatattatctgttgcatctttcatagcaacaatatttttatgtttagctaattcaacaactgttgcaacattaatatttattcccgttcttcctggaacattatataaaatcattggaatatctactgcatcagcaactgtcgtataatgtttgatcaaaccacgctgacttgttttattgtaatatggagttacaactaaaattgcatcagcccctttttctttagcataatgtgctttctttaaagctgttgcggtgtcatttgatcctgctccagcgataacctttacaccagttcccgctgccatctctaatgtaatatctaataatttaaattcatcatcaatatgaatcgttgcagtttcaccagtagttccattaactaataaagcttgaacaccgccatcaagcattctttgaacctgacatctaaatccatcataatcaatacttccatcttcatgcattggtaatactagtgctactgcactaccttcaaaaatagccataatttcctcctatatatttaagccaaaagcttcatctaattttttcattgctaattctttgtgtttcttatcaacaataaacgagattgttcgtttagaggttgttacttgataaaaatgaatgttgttatcccctaaaatagtaaatactttagccgctgccccaggggtcgtttctagtaattttcccccaactgcaattttaaaatatttacgattagtcgcaatttctaattgcttaacctcatcttttaatctcataattgcatcattaagattcttttgatatttttcatcaagtgtaatctcaatttgcatcgcatcttcaatcattacttgagaaatcatatctacatttaccccacactcactcaagattgtaaatatcttggcaataatcattgggtgtttaggaacatttctaagttgtaattgaataatattttcttcgtagctcactgcatcaataatattttccatcattgttctcctttacaaaaaaagttgcaatgagtatcattgcaacataaacagcgtatgaacaatgatagctcaccattatctattgataatgacagtcttatagatcttcactataagcccagaggataaacgcatgcaatcatttatctcttcggcgaacgctcctccctttttacctggtttgcatcttatggtaaaaacttcttaacaattcgcgcctctatctaatatctgtttacaatatatcacaatagatatcatattacaataccaattataccgctttaaccagtgtttttatataaaaacatgctcatttttggctttatcaataatttatatgaaacaaaatcataaaaatgtcaaaattatacaaataaagaaaaataactattcttgattatttttccagatagattgttttcactaaaatatgaacataaaaaagctatgaatttatcttcatagcttctatttttaaattatttctaaatccggctgtccgattgtttcattattataaacagcaaggtctaattcattttcacttcgggcaactaacattgcagcactagcggcaccaacaacattagttgctgttcttgccatatctacaatacttgaaataggtgctaataaaacaataatttcaatcggtaagcctgctgaagcaaataatgcagtagcagtaatggttgcagtaccaggcaccccaacagttccaattgatactactacagctaaaacaattaaaaatatatactggccgattgaataatcaatccccaaaacatttattgcgaagactgctaataaaactggccaaattcctgcacatcccggcatacctagattagcccctaaactagctacaaatgaagcaacatcttcattaactcctagtttctttgtaagttgtctaacagtgacaggaattgtcccaatactactttgagaagtgaatgctactaccccagccggccaaattcctttaaagaaattaagcggatttaactttcctaccacctttaataaaacactggttaccccaaaaatttggattatactcaataaatatgctaatcctaagacgctcaatagcggaatcagatcacttagagcactcttgcttactgcacgtgcaatcaatgctaatacagcatacggtgtaaagctaataacaaagttaacaacctctcccatcacacgatttccggcatctataaaatgcttaaacggtaaaacagctttttgctgattacgggcaatcttattgtaggcaatcgcaacaattacagcgaaaattacaataggtactacttcgccatttacccaactgttagccaaattgcttggaaataaattaatgatcgtatcgatgaatgccggaacttccaccgctttataatcacttgccaattgataatttatgccacttccaactttagttactactgctaaggtcagtgttatagtactagctagtagggtgtttaataataaaaatattatcgctttggcacttattttctttaatttgatcgatgttcctaaatttgtaatacttgaaataatactgaataataatagcgggataacgatcgctaagatcaaatgcgaataaatcgttccgattgcttctaaatacaaataatgtcctttaaaaatcaatcctacggctaccccaaaaactaatcctaaaatagttaaaagcccaaaatcatacttcttcactttacctagaaaatagataattgcgaagaaaacacctgcaagaagcacggctcctaattcaaaaatatttatattcatttaactgtcctctttccttaataaatttatttaacaacattattaattatgacaacagccatacattcgttcccattcaaaaatctttttattttttaatatctttacggaaatcatcctatccctcttttcctactatattagtatgatataaatttatactattgctggacaaatgtcaagaataatgaaaagttcttagcaaaagcttaagaactttataaaatcatatcttcttttttagttgacatggattgccataagctagtacgttagcaggaacatctttagttaccacactgcctgctccaataacgctattatcgccaatcgtaactcctggtaaaatagtacagtttccaccaatccaaacattattcccaatggtaactgctttcccaaattcaatttcttttaaacgctcttgtggatcgattgaatgacaggcagtatatatttgggtatgtggaccaatcagagtattatcaccgatcttaatttcacaaacatctaaaaacacacagccgtaattaatcataacatcttttcccaaatagatattacagccataatcacattgaaatggcggatgaatccaaaaattaccgcttgtattaataatttttttcattaagcggcttcgcatattatatacatgaaaacaccttttattatacctatgcaaacgccgcgctgtcttatcatacatatagatcagttttaaatctcggggattataaatttctcccgctctcatcttttcaaactcactcattttatcacctacttgttatcatcataacatataatctatacctcaattactagtatataaaattgaagtgaatcccctcgtcagtataatcctctacttatctttaataatacttttactacactggtatgtgatgataaaataaccaccataaataataactaaaaagattccagtcgttataatagcatcaaatacattagcctgattaaatgtttgcagcattatattgcaaacctggataccaaaaattgaatgaatcaatgctaagataagcgggaaagcaaaataaacagctatttgcttaaataaagaacgattaatcattttttcatcaacaccaacgttccttaaaatctgatattttcctttattatcaatgctttgtgacaactctttgagtgccaagatagcagcacaagaaatcaaaaatacaattcctatatataaaccaataaagataaccatagctcccatagacacactactacttgaaatttgaattcttgtattaatcaataagacatcagagctataactgtgcattttttcatctacttcgtttcttgtatcctgatcatttgcagcataattacccactaaataactatcagcaggaataaaattactaaccgcttcatctggaacaatatacactcccatacacatatgactagactgcattgataaaaaaccattttgacatttatcaaatttactctgatatatctttccgtttaactcaatagctggtttttctttaagaaattgatttcgactaaacattaaattttcataattccccattacaacatattcgtcttttaaatcataagttggtaaattatatattttagccaatttattataatcactaagtttaataatatcttcacaattattcaaataactttcacttacatctttaaaggcactgccaaaagtatctctatatgtcaattgtgaagtacgataagtcataaatgtataaatgttttttaaatcatctaatcctatttgcttttgagacaaatattttgtaattgataaattatcaacacttacatctttttgcatttgaatatcaactggagctaactcatttatctcttctgttgcagaattatttaacgcaaaagcacttgaaaaaatacagattgttaaaaaaagcattaaacaaattaccgttgttgaaagtactgttgtattaatcttactactaatttgtttaaccgtaaaactatttaaatttttgaaataataatttttagatgccataacaaattttaaaatcaaacctgaaatagaccaatagattaaaaacgttgcgacagcaccataaatcatttggaaaagcactgagctgctgttcgttaaattaccagctcctgcggtaacgttataataagcataacttaataatacaacagcaccaataaagatccctatacaaagataggtattctttaatttaacttcttcattttgtctatttgctgtcaataatttaattaattgttggcgattcacttgaatcgtattaaaaaccataaccagaagatacataatcccaaaataaatcattgtttttatccacgcacttaaagagaaaacaaatgtaaatttagtcatgtctgcttcaaacatattagctacaacaattgacattacttgagatagagcgactcctaagactaaaccaattactaatgaaatcaaaccaattgttatagtttcaactaatagtattttagaaatctgtttttttgacattcctaatatcatatatatcccaaactctttttttcttcgcttcattaaaaattgatttgcatagacaattaaaaaccctaatataaatgaaacaaatacacttacgcctgacaacacattattcattagtttaataatatctttagttgaactatttagtttcagcataactgtttggctttccaaagaattgaagatataaaagattgccactccaaggattaatgtaaaaaaatagattgcataatctttaaaactttttctaatattctttaatgaaagattaaataacatcacttacatcgcccccaagcaaagaaacaacatcaataattttatcaaaaaattgtttacgagtagcttcacctcgattaaattgattaaagacctttccatctttgataaaaatcactttagaagcatagctggcactaaaagcatcatgagttaccattagaatcgttgtttgatagtcttgatttaatctttgaagtcgttctaataacattttagaacttttagaatctaacgctccagttggctcatctgctaaaacaagtttaggatttgtaacaatggcccgcgcactagctacacgctgtttttgtcctccagacatttcataaggatatttatttaaaatatcttcaatatctaattttcttgcaacaacttttatttgctgttcaattgctttagctttaaaattttgaatttgtaaagccaaagcaatattttcataagctgttagcgtatctaataaattaaaatcttgaaaaataaatcctagttcttcacgtctaaacctatttagatcattacctttaagttttgtaatatcctgaccttcaatataaatatgaccacttgtaactttatcaatagttgaaataacattcagtagtgtagttttccctgaaccactagcccccatgatagcaataaattcacctttatcaacattcattgaaatattgctgatagctttagtaagattactcttatttccataatatttactaatattttcaatcgttagaatattttccataatcttttctcctttacaattaaattatagaaaaaaggcggtcttggtaacatcgaaataacttacatcaccttacaaccttgtaatattgctcatcattaaaagaaattgttactttcgtatattcactatatttagattcaattataatcttatgacctaatttatcacataatcgcttaacaatatataagcccatccccgtagaactagaaacaagacgcccgttttcaccagtaaatgatttttcaaatactctcgttagatcactagtcttgattcccagaccattatcaattatttctaaagcaatattattccttctaatcacattaaaagctattttacacttatctgtacgccgatatttaatactattactaacaatttgattaataataaattctagccacttgctatcgcttaaaacagaacaattaacttgaccgatttcgatcttaatattttgatacaataaactatcttggttcttcttaataacatttctaataattgttcctaattcacattgtttaatcaaataatctttctcactactatcttgtcgggcataatataaaacttgttctacataattttcaattcgactaacttgatcctttagttttctttcattatgttcatgattatgaatcatcaactttacactagaaattggtaatttaacttcatgaatccataattcaatatattctttaaaattcttaagattatcttgataagtctcaatctcctcatacattgacttatcaatctcatacaatgcctcatataaaatctttccttctagaaaatcaggctgagcaatcaattctgtaattaaacattttttatctaattgatttaatttaatgcgaaaattattatagaaagcatgtttttgataataatcatatccaataagcaaaccactaaataaaagcataactaaaacaatagcataaattaatgcatttgaaactttaaacatcaataagaagaatagcacgctcacaatcataattattaataaaactagataggccagtctatctagtaagtattcttttattctcatattaacatatacccctgatctctccttgtttcaatcacatcaaaaaggccaatcttttcaagtctttttcttagtctagtcatattaactgtcaaagtattatcatcaataaatttatccgtaccccatagataattcataatatcatcacgagttacgattttcccttgattcataagaagataataaaaaattcccatctcatttttagataacaataattcctgatcatctttttctaacgtacttttcatcaaattaaccctaatattttgataagtcagttttggttcagctttatggagtcgcttaaaaacagcttcaatatgcagtaataaaatcgttggattatatggtttagtaatataatcatcagcaccatagcttaatgcaagaatttcatcgatctcactatctttacttgtaaccataataactggaatagttgatttttctcttaatttttttaatagctgctgtccattcaaaaatggaatcttaatatctaatagaatcaaatctggatctattactaaaatctcttctaacgcattttttaaatcttttagaatgattccttggtaaccattattatctaataaaacttttaattcttctcgtaattctaaatcatcttcaataattaatattttcataacgatctcctcttttttattatacacaattattttttattacatagttatcttacaaagatgtaagttattattatctcattttttagttagaaagattcgctacgataattttaaaataaaaaagggacaaaataaattttgtccacggggtgattaatcactacagatgattatcacctttttttgttttataaaactaccaatgactatggaacggtcaaatttgatcaattagaaaagggtgtttatctgcttcaggcaacagatatcaataaatatgagaatatcgtatcaacattgatatccgtacctgtatttaacaatgaaagcaaaaacagcatgaattatgatatcagtattgtccctaaacattcacctgtaattgcagtaaaaacaggtgatgcatttgatttgaaactatttgccgtattagcaggagttagtgctgttattattgcaataatacgaagggaggcgatatagatacaaattaatatttatttagatatcaaaatgatatcttttttattttaacttaaagtgaggtagaaaaatgaaaggattaaacaaaataaaaaaatgctggaaacagcttatgttagtactggcgatgtttttaagtatcagtgcatcgacattaactcaggcaaatgccttaaacgctacattgacctggggacaggaaatcagttatccaagctggcttggaaactggtctacaaaaatgtgctatataaacggcagtttagcgtattgtttagaagcatcaaaagaaactcccccacaagggcagtatgcaccttatgttataaaaaacaatgatgctttattgaaagtgttatattatggatttggcggacctggcgatgtattcagagacgaccaagttacaaatgatactactaaatatctttatacgcacattatggctagttatgcatattcaggtgatttatatggtggcaatgattgggatgacttagaagcacatggtgttggtttaaaagcgagatacgatcagattcagtctatgcctgtaccaacaaaaacatttaatctaacaaataataatgttcaagcttattttgaagaaggagtacagagaacagaaaatataacattaaatacatcatcagaggtaactattagtattccactacaaaacggggtagagcttcataatgtaacaaagggaacagtaaatactggaacagtttcgattaacggtggtgatactttttatttgtcagcaccgttacaaaaaatggatgattatagtagcggggaattggcaggtaataatcttacaatgtttgcgcctttagcaatttctgcaggtggaaactatcaaactgaaggaacaatatcggttactactgatcctcgtacattgagtttaaaagtaaagtggatggatgtaggtgattttgaattaagaaaaacaaatgatacaggaaaattgattgacggttcagaattctcattaaaacatactacacttgattttgaaaaaaaacttgtagtcaaagatggcaaattatcaatgagcggtctgcctgttggagaatatctgctcactgaaacaaaagtacctgatggtcatgcggttcttcaaaagacgtttcaggtaacaattaataaagatcagataacagaacagatcgttgtcaataaattaagacctacaggtacgttagagataaataagtctttagaagcttctaatgaaaatgcagtaaataaagctgattatgatttaacaaaagtacaattcaagattactgcaaaccaagatatttatgatagtgtttctttagaaaaattatattctaaaggagatgcgattactgttggctcaggtaaaggaagcaatgatgatgtcgtaaaattagtgaatggtaaagaattagaaaacggtatttattcatgtgatacaaatggtaagttatctttatctggattgccaatgggaacatataacgtggaagaaactgcctgcccagatggttttgttttagagaaagaagtcaaaacggtacagtttgcacagcagaattttgttacgttaacttacacttcttcattaaatataaataatgaattaacaaaaacagttttcagcaaggtaactgctgatggcgataatctttacggtgttccaatggaaatcgtagatgtcaaaactggtaagcctgttcatacatggatcagtgatgataactatctagaaattgatggattaccagttggtgattatcaatggagagaagtaaatgctccagaaggttttgttttagcaaaacctatcgagttcactgtcaaagatggagatatccaagatattgaaatgaagaatttcagtgttgagtttgcgaaaaacggaaacgatggcaacaaacttttaaaaggaggagaattccaggtaacaagtaaaactaaacagatcgttgataaatggacaagcggtgaacatattttcgatattactgaggatatgaaaactaaacttacatcaggtgaagttgttagtgatatgtttattaacattgaagatgattcaagtacatattacagaatttctaagaatgcagatagagatgattatagacttttaatgcaggcaaatggtgaaactaaatattataacatcgatatcaacggtgatgaaacaacacatatgatcagaggtacagttgaagatcaggaatatgttattacagagcttaagagtcctgatggatatgcaacagccgagccagttagctttaaaacaaataaagaacaaaatttaactgttgacatgacagatgaaattactcaatttgaattttataagaaggatataacttctcaggaagagcttgaaggtgcaactttgcaaattaaagataaaaacggaaatattgtagatgaatgggtatctggaaaaacaccacataaaattactggattaactgttggccaaacatatacaatgatagaagtaattgcaccagtaaattataaaattgcacaaaataaagaatttacagttagcgatactggagaagttcaaaaaataacaatgtatgatgaacttatgcctgttgctaaaaaggtaaaaactggtgatttaagcaatccgtttagttatcttgttttaacaggtgttgcagttttaggaatgtcccttgtttattatagaaggaaaaaaagttgttaattaaactaaaagaggcaatttgcctcttttttgtatatgctatttaaaaatttagatggcatatacaaaaaaagaaaggtgtgtggagaatatgaaaaaaagatatgttgtaatatttttacttatattaatgttttttattagtggctgtcaaagtgagttattcagtgatccaaacttcagcaaagataaaataaaatttaatagcgatatagtaataaactatggggaaaagaatgttgatactacaaaatttgtgtcgggtatagatgatataaaaattaaagacagcaatagattaaaggatgagctaagaatcactgttgataattacagtattatctgtcctgagtttgatgcagatgaattaggtaaacatgtacttgtttattctttaggtgattacaaatacaaagtagaagtaactgtaaaagatataactgcacctttgattctattacaaaataatgaaattgatttaacggttggagaaaagttttcaaaaaagaatttagattacaaaataaaggataatctttccaagaagaaagatatcaggatttcaataaaaggtgattataattctaaaaaatcgggtaagtacaatcttaaattggttgctaaagatgaagcaggaaataaatcgagtgctgattttattttgaatatatatgaaaaggcttcactggagattgacaaaactaatatttcattaaatattggggagacatcgcttgtatctgcgaaggttaaaggaaaagatcaaagtgtaaattggacgagcgacaacaacactattgtggtagttgataatggaaagattacagcagtggctccaggtactgcaattataagagtcacatgtggaaatctcgcaaaagaaattaatgtaaatgtaaaagctaaagagacaaacaacagtgctaacagtcaaaattcaaataataataaaaataatgcaaataatagttcgagtggcgggacaggtggcaataaggttaccaatccctcacagtataataaatatttttctggggtatcgattgctacatacaatgaagcattaagttatgccgagggtaaagtgaatagtggggtcgtaaattcttattcattaatgccagatggcaagggatatcaagtaacattcggttagataataaaaatccatgtcaatggattttttattatatatttttatattttgaaaggagaaaaagcaaatgaatattattggaattatttgtggtgtagttgttgcagtaggatgccttatcgtttttttatgtcaactgattaaaaatgatatcgaaaatgtaattgtatttattgtaacaagactggctattgccatagcagctggcttaactgttgcaatggcattatcaatttaaggaggaataattatgcgaattaaactaaataaaaaattattagtaagaaaggaagatggttcagtaaaccgtataacaatcaatcaaaaagattactataaatttattttgccaaaaggatgtgactttggaaatacattagatgaagatggaaatgaagtaggaaaattaccagattcaatacgtgcctcatttatcgtacctgtctggtatacaagtcaggcaatagaaggtgaattatgttatattgattttcctgataactataagtatttaaaaattactttagatttgggcaagagcgaagaaagattagaagatggtagacataaacatcttttttctgcaattgaaaatatttcgccaaatgaacttgcagatattattgaagatacaaagtggttaagttttaccgtttcggtaaaacagttaggtaaaccgtatcaaactgaacagggaaataaaaggataagcattttacttccaaaacacgcaggtgatttgatggggtgcagagcaactatcagtcagaactgtataaaagacataaaaggaagagatgatattaaaattgttaatatcccaaaaaactctaaatttaacataatgcgttctaaaattgttggtcaggatattgaaaaccaaatgaaaccagtatttggcgataaaattatcgaagcaacagtaacaggaaaggaattatttgagttgtttaaaatacctaatgaatacgaagaacaaactactcacgaagtggaaagtgaagaaatggaacaaggattataacggttttgatgtagttttagaaaggagactttatgaaagaaattattacaatggaagttatcaaaataactactatggggtcatttgatccattaattcaacttgtaaccccttttgctgaagatgcgcttttgttctttcagacaatggcagtattatttgctacagctatgggtgtatattataaattaagacaaatttttgctgatgcacaggaagatcaaatgtgggataagaaaacaagaggggtatttgtaggactggtttttatttttgcaattcctacagtaatcaaagtattatcttcatattttaattagaaagaggcaatttgcctcttttttatatttttgaaaggaggtatagaattggaacaaatgttagaaaagtggtatgaattttttgataaagaaagactcaataagtggattgatgaagataaggaaaatcgatctggttttattgcaggggttaatgaaaagacaatcaatgaaattaggaatatttttgaaaataatattgaagagtttattgaattttatgactatactggtggtcaaatattattaccaatttttaaaataagagatcagtatagagaatttaaagagagaaaagtatctaatgaatatggatattatgttagggatattccaacaagcgaatctagtgatataccattcttttttgaaaacacccaatctttagatgggcttgatatttctggtggtagtactgaaaataatgaaattatcgagctattgaacaaactgcttggagaaatttcctctgttaaaaagatgaatatagaaaataatcatattttaaatgaaattggtaaaagattttacaatattggaaactcaaaatttgatataaatgatgaacagatcgaaaaattaaaagaagtgttaagagaaataggatatgagattgaaaatgtaaaccatgaaaataagaaaaattttcaaattattttacagcacataaacacatttgaaaccaataaaaataacaaaataagtaagtataaagaccatattatagaatatgctaaaaataatatattcagatttacagttatatgctcatccatcagtatatttattacgattgttttaataaaaattatggaggtatttgtaaaatgatgatgatgggcttatttagcggaatcagcgaggatgtagctaatttttttagagatttcttatggaaactgattgaaactgaaatagactgtgtcacaaatttaattaatgcacttgttaatggcgtattatcatttggaattttagacaatacatggattcaggatggatataaagctgcaattactctaatgtttattatcttgcctgcaaaaataatttatgagtttatttttgcgatggttcgagaagatgataatgctagcgatgtgaataagaagcttggtggagcgattatgggagttatgcttgcagtttccttaagtatagtagttcctctggctaataatctgtctataaatgtatctaaagcccttattggtcaacagtacagcgttggaagcagttcaaatggaaattcttggaatgataacagcggtacatctttaaataattcatcatcggcatctaatgatacaaatcaaaaagatttagcgaaagagctggttgtttctactttgtgtgcatttggcggtatggatagaaataatacaacattttcttatgtaactaacgaagatggagtaggaatggatataggtgctgaaagattttatgactatataaccaacagtgacggtgctttggcaggatatgaaggtgagcctagtgaaaacagtggtgtaagatcatcagataattttttttcaaagggaatttataaccgatggtcattttactatcgttgggatgtaaacggtaatgggactgacggtagcgatgactgggatcttcttggcagttgggattcatcatcatcttttccagagtcatcaaagtctgatggcggttatggttcaagaagtgtcccgtcaaatgaaacgcaggctaaacaggcatacgaatatatttgcgaccatgcaggagattatatctgggactttggttatattggaacaatgataggactggcgatatttatgatacttctttttattattacaattgaagtggcaatgagaattattatgattggatttttatatgtaattggaccgttgtgttgtttatcacttacaaattatcaaaatccgcaggcgtttactgtatggaaaaataccattttaggtatattttttgtaaatgtgactcagatttttatgttacagcttttaatgaatctagctggagatatttctaaagcaggaagcggaaatagtaatgttattgcttcgattgcactgtattttggtactttttctgcaattattgctttgcctaaatatgttcagtcaatgattggaggttatggacaaggaataatggaaagtatgcagcagctaaaaggtgcagtaggtggtgcatggggtatgactggaggtgctgttttaggagctggaagaaaggtcatgggtcgacataatgataatactggtcatttaactggcggattgcgtggggcaattatgggtaataagcattatggtggacagcggatcggtggcttagctaacagaacaagggcgatgagagatggtttgtttggaaaacacgaacaacagaagaaagatgcccaatctggaaacagaagcggtaatgaggaatataattacagagcgggtctaaacagtgctactggggacaatgtgaatagtggcggtgaagaccgttcacgtatgaatgccaatattggatcattttctaatctaggcgcagacaacgcaaataatgaaaaatatagccgcacgaatgtaagttcaggaacatcggctaacaaaaattcaaagattaatgctcgttcaggaggtcttctgggacgagatggagtggcaaatagaacttataatgcaggtaagtcatttataaacaatcctacaaaaacaacaaggaaagctgttaatggaatggcaaatgttataggggttcgtggtactggtcctagaaactggaataaaggaaatagtgaaaatgaaaataaaaaatagaatatacatgaaaatacatttgtagcgtgaagtgaattaaggtataacgaacttcatgcaaaaatacgttcagctgcaagacatttatgaaatacatagacaaaatggaattaagaggtgatgaataaggatgaacagattattttatactatttttagcaacattgatatatttaaggtaataaaaaacatatttatctttattaccgaatgtgtagcgatgaatttaatatttttaggtctggcatgttttgtaaatccagatataatagtcaaaaatttattaactgaactttctttaaaaaacagttatgccttatatttatgtataataattttatatgaaggaagtagaaattttatcagttatgctttttttgatagaaaaatcacttatatcagaggttcaacaatagaacatatgaaaaaagtgaaagaattatgtatcgaattcaattgtgaagtaaaagtactaaccggggattcagattacaaggtcagactgcttggaattatactaatggttcttgtctgcctggcagttttgttctgtacatgtgtaataattcttatcatgtacggatatctgcattttatgctaggtattttactatattaaaatcaggtgatgatactttataggaggtgtatagatggttgatcgaaatgattacaaaataattatcaataaaggaaaaactaaagaaaagttttttctttttttaactgttggtgagatgggattttgcctttttataggtgttttgagttttaagttttttggaatgtttatgagtgaactttattcactgctgatagcagttgttttaagtgcgtctatagcatcgctttttatagaaataccagtttcgcacctcagtgttctacatcatttaaaactggcatgcaagtattattttactttaccaaatcagtattactattatcgtgataaaaacaaagaagagaacattaataaggaggaagaaaatagtgatttttaccaagaagaaaggtacacagcaagtaaaaaaacaaaaaaagcagacaaaagaaaccacaggtagaacacgtcatataaaatatgcaattcctgttacatggaatgaagacaggcaatgttttattgataatgaggaacattttattttaatggcaaaaacagatggtacgaacctgtttggattaaaagaagaagatcaaaatgtatatatgaatgcatttgcttcgatttttaattctaatactggttcaggacaaatttattcttatgaagttcctgcagacgttgatggttatataaatgattacaattatttaaaatctcaactggatgttgttggaagcgagatagatcaaataaaatataagattttggatgatgcttctataagattagaagatacaagtgttactagagaactggtagatcgatgttttgtgattatattaaaagataaagactggttcaagctcgaaagaagattggcagatgtgatttcgtatctaaattcatatcaaagaaccagacttatgacaccgcaggaaatgttagaagtggtatataattactataatcctgcaaatggaaagtttgttccttcagtttataaagaccagtttggtgtaatggaatgtatatatccagattatattggtttttacgataagggctttaatcagtcaattgtattaaatgatttgtattgtaagactaaatggttagcaacgttttataaagagcctgtaatggctcttttgtgttatctggctactgccagaggagttgatttttcacttcactggtcacctgcacctcatgatgctattacgaaagatatagataaatctattagagcgctagaaaaaagagcaaataatgaaaaggatttatcaaaagttgccaagagtcaaaaggaaatcaatgaaaatattgaaatggtagaaaaattaataaatgatggaaattttccaatttattttagcgtttcaattagagttgttgccagcagtcctgatttattagaagaatccgtcaaagcaattgataaagatgttaaacaattcaatattaaatttagagatggtatacaccagccactggaaatgtttaatctgactgctccgatttgtcaaaattatgtagaaaattatatgttggaaactacagcggatacaatgggatatatgtatccttttgtgtatgaggcgttatatgattcaacggaagaaatagataaagacagtaaggaagttttatatagataccctcctgtatatatagggaatactaaaaatacaaacggtgtagtattttatgataactttgtaagaaaaggcgatagaactaattctaatgaatttattgttggtacgactggtatgggaaaaactctattcttgatgtggcttattaaagagcgatatggtttaggatacaagcagtttataattgatattgaaggaaaagaactgcataggctggtacatgttttaggcggggaaaatataaactgttctgatggcagatcaggtttgattaatccacttcaaattagacttaatgtacctgaaagtgaaaaggataatgaaaaaacgcctttaactgaaatatttccattatcagaacatattagatttttacgttcattctttgatgcttataaaggaaacgccaaggaggatattagacttcttcatgataatttgatagaaaaagcgttggaaaatatttatagaggaattggaataacttatcaaaccagtgcccaaataattgtagataattatagaaataaagactttccaataatgcttgatctttataatgagctgtacagactgctggaaatagcaaatagtgagaaaactcctaacataaaagagataaccagaattaaagaatgtattgcatttgttgagcctatggcatgtggagcagatgcttcgatattcaatggtcacactagtattgatttgaatagccgactcatttgttttaatgtcagtggatcacaggataataccaataacaaagtattattaactcagtattttaatgtactttcttttatatggacaagtatagtatctaacaccgaaaacattagacagcaactatataatgatgagtttggtgtaataatggatccacgctgtttagatatcatgatgtattttcagacaattgctaagcgaattagaaagcgtaagggtggccttacaactgcaactcagcagatttctgatgtattaaaggactctgtaaaagatcagggagaagcaattatttctcagtctgcatatcagttttatttcggattaggatcaggtggaattaaatattttaaggatacggaaagcaatttgattcctgaaagcgaaatggaatttattcagtttgctgaaatgggggactgctattttaaagtaggttcacaaacagcgatgagaattcatattactttgcctgatgatgatttagaagagtttgaacgaattaaagcggattattaaagcagattagaactatatgaatataattaacaatattaaaaaaactattgcagttacattactggggggtggcatgcctctttttattatttttatatgtttggcaatccttcttacttctgtttcagtgtcatcagacgatgcctatgcagaacgagaaggaatgcaaacaattgaacttttcatacagattgctaataatgagtatgaaacttgcggtaatgttaaaggcggtgacaagtatcgaaaatggtatacaggtgctgcggatggtgcaccatggtgtgcaacattcgtctcttacatcgcctacaaagcaaatattttagatactgcaatagtaaaatttgctgactgtgacgcaggtattaagtggtttagagaaaaaaatcagtttaattatacagagtattatgaggcaggaaactcatatgtaccgcaacgtggagatttgattttcttttcatcaaataaaaataaaaatgattctacccatgttggcatcattgaagaatgtgatggcagcataatcaaaacaatcgagggtaacagtggtaatgctattaagaagagaagttacagcatttcaaatgaaactggtactattttaggatatgcaactcctaattatccatcttcaggttcggcaaaacttgaaggagctttatcagaggcatttaaattttttgcttctaatgagtcgggaaatgattataataaaggcttttctaagggtgatggatattatgcgttagggtattatcagtttgatagtcgctatgacttacaagaatttttaagattttgttatgagacaaatcctactttatatgcgccgttttctaattttttgagtgtttcaaaatcgaaattaagaaataataagaatttagaaaaagcatggcatcaggtatatgaagcagattcggaaaattttgcagtgatgcaggatacatttgaatacaataattattaccttccagttgaaagcggacttgcaggaaagggtatcgatatatcttcaagatgcgatgctttaaaaggaatgtgctgttcattatcgaattgggctggaacaaaaacagcagtaactattattatggatagcaggattaatagtaatatgaacgataaagaattcgtttcaagagtgtatgattatctttattcattaaaatataatgattatgcaaagtacggaaagactgggaaaaaatattataatggatggcataatcgttggaaaagagaaaaagaacagtgtttaaaatacatccagtaataagggacggaggataaaatgaataatgaaaataaatattttataaaatttttaatactggtaggaattttaattgtaattttagttggatatgcaggttttaatttttttaatataagcggtatttttaatgaaaaaccgatttattatttttgcagttatcatgatgattattatttagatatgaatgataatcagatagtaaagttaaaaaatgatattcaaaattttatggaggagttggattatgttgatgaggattacgacaatataacttttcagtcagtcgtttatgaaaaaaacaaggacgttgtatattatttttttctggttgatgatgaaatgaatactttgtacgcagttcaatttgataaaagaagtaatagttgggataagaaatttgtgtggaatggtgatgatgataatcgtgattatcacgatgaaagtattaaatactcgtatttatacattgtagataaagaggaatatgataatcaaaaatatcttaaagaaatagaagatacgccaactgatgatattgatcctgaaattaattactgagtgaggtgaaagtatggagtttaaaaaaagtttttggcgtacacggattttatgtatgattgattcttataataagatttcattagaagataaacttgacaaagaggaaattcttgatgatttgaatggaaaagatacagaatattatctgcacgtataccttaatgtaagaaataaatatcataaattaacaaaaaaatttattaataatcaaattggtaagtaattatttatttatttattttaataaaaagaaaggggaatggtcgatgggaatggttaagcttaatgaggaatatcttgaaaaagttaaaaagcatagaaaagaattgcatattacacaattgcagatttcaaaaaaacttggatggtcattatcaagatatcagcggtttgaatctgggttttataaagaaattgaagatgatgcaccaaaaaaaatcaaagaagaatttggtatagattatagtttgttacaagaaaacttcgcatcagcagtaaaaaaaacaattagatttccgcaagatttacatgataagatagtattttttcaacatgagtttgagtgtgatagcttttccgaagctattattttttgtttacgtgattatactactaatacggaactggcgagaacaaaatatgagatgaaagatttttttgaggaattaattcttcaaacatatgctaaaacattaaaagaagcaagatatgaaagtagtaaatataaacatttattgaaatacttagaagaaaaatacggttttgaaagtgaatacgaacaacaactacttaatgaaattgacaacaaaaagaatcacgccagatattaaaggagataaaatgaaagatattataaagataattttatatgctgatgaggatgtttacttaaaaatatatgatcagttttctaattttgatgaagatttaaatcgtgaagtacattattttgatagagctaacagtgatgttagacacatcatgacaaataaatatataaacttttctataaacaacactggtggctatagaaacgtttcgcatgtaattatccaaaaatctttttacaaaaacaaagatattatcaaaattctacggacatttaaactgattaatcctaatgtaaaactgcttttatttatgaacgatgacccgtcatattattcaatgctgatgtcaattattgcaaatgaaggacttgcatcaatcgcattttccattgatgatattgaaaaatggttagttggaggtggtgaattatttgatcactccgaattgattattaaaaaaataaccaaaaagaaaaggaaagaatttctcgcctattgatttaacaataggcaagaaatttattttattaattcgttctacctaaatattccaatattttcccaaatatttccataccagattccaaatattccctgaatattttcaatcatttttaggtagcaggataaggcagtccgacaggactgcatatttggagcttgttcgcagtgcgaacaactagtgctgaatcattcttcaggcgatttcctcactgtcggacaaactgaatattattcaaataatattcagttttttcctctttattttcctcaaagaatgattcctgagtcatttttcagacgatttccgtctttgtcttccaaaagtgaatattcctacttatttttgattcagtattcattcaaaaaatgatttctaaatcatttttcaagaatattcactttttgtcggacgaatttgtcatattgaggcattatgcctctttttatttattcaaagaaaggggatgtgtaaatgagagatcctgataaaaaaaagactatctcaaatgaagtgatattcaatgtgataggaattgttggtgttattttgttagtgccaatttttataacgtttgtattctggtatctggatacaaatgtgcttcaacaggttgatgaaaattttttaaatacctttgtatcccattcaaaagaaatattaattatcagtgtaagtttgtatgcattggcattttattacgtagtgacttttttcagaacggtaaaaccaaaaaagacggatatgcttgcaagtcagtgttggtctactgttagtgagcagaaaaaattttttggttcaaccgtggtggatgcaagtcttaatcttgaggagggaggctcaccgataaattatctacctaatgaaaacataatcctatatgaaaagggagctgtacatgatattgtagttggaacaacacgctgcggaaaatctagaaagattgttcgccagcttgtaatgatagtttccatggcaggtgaatcaatgatatttaatgatcctaaaaaagaaatgtattttgattttagaaattttctggagaagaaaaaagattataaagttaactgtcttgattttagaaatttacaatacagcgatggatggaatccgttagattcaataattgactgtttgcaggatagagatgatccagatattgataatgcagatcagtacagtcaggatatggtaacatcaatcgttgttgatagtgggaaaggtgaacaaatctggatagacggtcaaaaggcacttattaaaggaattatattagcaaactgtcaggctaatgtatctgaagataaaaagaatttctattctgtttatcagacgcttgctcttcttggaggtgagcaggcatacaacaataatcctaacgacaagaagatgaaactttctgcatatatgaattctcttgatgagacagatatagcaagaacagcttatacgacaattactaattcgcctgaaaagacgagaggttcttttatgacaagtgcattggcaactttacagctcttttcgagtattaaactgatgaaggtacttagtaagagtgatttcagtttcagagaatttacagagggcaagcgtgctttgtttattgttaatcctgatgagaaaaaaacttatgatagaattgcaggtatatgttttgaccagtcatatcaaactctagtctttgaagctaatagaatgcagggaagaagattgaaaaaaaaggtacacatgatttatgatgaatttgggaatatgcctacaattgatgcgatgcagagcaaaatgactgtagccctttctagaggaattgtataccacttgtatgtgcagggatttgatcagctgaatgatagatacgatgaatcgattgcaagaattattcggggtaactgtaaccttacttattttatctcaagtgcagatttgaatacatgcaaggaagttgctgagagtattggtgatgaaacaatctggggtccaagtcatagtgccaattataacccgattgcttcttctactggcagtggtgtgaactattcaatgtctaaaagacagcttgttgatgcaaatgaattaatggtggcggacaatcgtgatggaaatggtattattgttaagaggacttacttttctccttcaaaagtatatttacctgactgctcagagtatccatggtacgaagaaatgaaaacggatgaaacggaaattagtaaagcagacagggaactaaactgggcagtcccgagatgttttgaattgcgagacactgaaataagacaagcggtttatacagatgaagattgtaattcaattagtatgagtgaaagaaggagaccaatactgactcaaaaaaattcaatgcctaatgaaaaagaactatactggtactggtctatgagagatgatctgtctgaaagtgtaaaaaagcatgttattcagcatattgccaactgcaacaaaatactatcaagaaaagaaataatgaaatatctaaaatcaaaagaattttttgattatataaatccaatagatgtagcagataaacagaggcatttaactgaatcggctgatagagtaaaaatggtaaagacagcattgcagtcatttgataataactcatcccaaaagcagtctacgttaatgaagaaaatagatgatttatcagtaccgcagttaagagaactagcaagtgttgctagagtaattagggacggtaaagcaagaaatggctgaaattatttttaatgctgaatttgttaaaacagaatatgcaggcaactgctgtaaaaatattaaaaaacaaattaatactgatgagatggttgattactatgagcgaaaagaagcttgtgattatactgttgatgaaaacgaagatgatgacacatatcagataaattcacaagatgctttcaattattatgattatcgaatcgggtctactggtggatttaatagaaatggtaatcttgaaaaaggagaggcgaacaggctgatggaaaaatatcagccaaaaatattatggcgctttgtgttttctttcgaaaaggaatttgcccagaacagtaatataattactaagactaatatgcagaagttaatgactaaatctatggagaaaaatattcgtgcattaggttttgatccgcaaaatgtcgaatggggcgcatattatcataccaatacagataatccgcactgtcatgtgtggatgtttgaaaaagaaccaacaaaacgttattataaaatctcaaaaaagaaatttaataaagtacggtcaaatgttattagaacaatggcacttaatagcgaaatttatatcgaacgagataatttaaaagaggaattattaaattgtattaaaaatgatgaattaataaaattgtttaagtcttcaaaaaataattcaaaaaagtgttttaagaaaaataacggaatcatcaatcttcttttagatctcaatgataaattaccgctaaacgggagtttaaaatataattcaaaaaacattcgaccatatcatgatgatattgataaaattgttgacataattttaaatacaaataatgttaaattattttactgtcaatataaaaaacatcttcaaaaagaaaaagaaatgtttaataaccgttattttagtgatgaggagaagatggagcagaatcgctccttcgagaataaggataaggagctgaggactagaatagccaatatggtattgcagaatattaaaaattatcgtttggataatgaacattattctaaattggaaaataaaatcaaaaaggaaacaatcaaaacgagtgctaagaaacattcgtatataaataaatttagtgctgttaacgcatcgaagcattctatgagttgtcgaagttctctgttgcaggcaggtattttagatgaattgtcaaaagcaataatggaaagcagtaatgcttcaagaataattgaaaaagaattagacgatatggtaaaaaaagcacagaaagaaattagggctaattcatttgagcgctcattataaaaataaatcatataaaagaggcagtttgcctcttttatattttaagaaaggatggataagttatggacaaacaaattagagaattaaataaaaaaatagcagcgttggagaaaaaaattaatgatgcacaaaatcaaatagataagatggagaaaataaagaaagaagcaaaagaggaattaacaccattaaacagagttaaagaaaagttgacagcaattcaaaatgaacttgaaaatactatccaaaaaaaagaagtgactaatgacaatgaagaaactgatagaagtctacaacggtattaataaaacatattactgcaggtgcgatttaaatgcatttgggttatcttttaaaaaaacaggaaaatattctggtaagtgggtcggcaaggcagatgaagataaagcaaatgcaatcaaagagtactgtataaaaaataaactgagagtaaatataacagatctggcgtacacaagggctcataactacagagaagtatattttgagaacaataaaggaatttttggtgatggaagatattatcattgtgtatattgtggaaaaatcttaaaaaaagataaagttacagtagatcacttttttcctatcaataaagttaaaaacagtccgtattccagtattaacataagactactaaaaaaatttggaatcgaagatattaatgataaaagaaacctcgtatgtgcctgcaagagttgtaactcgtcaaaaggatcaaaaggtggaatttggcttgtgagaggctatcttggaagattttttatcttatgggtattattttatacattacttctatattttataggatattatttaatatatgcttttaattgttttattaagtagtggggtaaaaatcatgaaaataaatggtgtcacaatagtgaattttaaaagtgataataatctctatcaatgcgatgtaatatttgatggaaaatttttaggatgttataaacagaaaaacagttatagtgattattgttcttttgataaaaaattactgtatgaaagcatggtaaaatttaaggagagtaaactttataaaaataattgtttcgttacagatgatgatgtaaaagatttttatacggtagatatgtttttaagtgatttgtgcgatctctttcaagatgaatcacttttaaaaaaagcaattagcgaatacgatgaatttgaatgtttattaattggagaatcgctaattaccaatgagactctgtattgtattttgaaaatgaatgatgaattagaaaataaaaaaaatataatgagaaaaattttaaataattcagtggtttttaggagttataaaagtctaaatgaatttattatagataacagataagttagcaaagacctggattataaaatggaggaataaaatgtttttaactgagaatgaattaaaagataaattttggaaatcatacaatggaaataatcgagcgttgagatatcagtttgagtgcagtattagagaaggcaatgctgatcttgtaacagttgaaaaatatcaggagaactttcagataaacgcatttgagtttaaattgaccgatataagaaaagtaattagacaggctgaagaaaatgcaaaacttgttaacaagagttggattgttattcctgctgatcgtaaaagtgtgataagtgataaatatataggagcgtgtaaagaaaaagggattggaattttgtatgttgaagatgggggacggtggagtttggggctgtcacctagatataaacgtgaaatacctatgacacagcagctgcttaaccttatgatgaaaggatactaaaaagaactgtatcgatagcataattgtatttactcaataatttgttataattgtaataggaggcgatatcatggaaagacaaaatgaatggaaatcttttttaaaaactccttttaaaaattgcaggtatatttatccgattcaacaaaaaaaggttgaaaaaatgataaatcatttaaaaaacaatgacaatgtgattaaaattatagttttcggatctagtgtgacttcaaagtgccatgcaggcagtgatgttgatttttatgttgaagttaaggaagataaaagaattattacagattatttagactttctttatgatttgtggactaattacaccgttgatgagaatatgaaaaaagaaatatttaagaaaggagttgttgtctatgaaagagaatgaaacacttttagataaggcaaatcaaaatctaaatattgcaaatacattatatgaaacgtatagatacgatgatgaggcatatttaaattatgttggctatcatttacagcagtctgtagaactttcgcttaaattctgtttagaaatcaatggagtagaatatcctaagacccatgatatcactcagctgattgctttaatcaataaaagtgaagtagatattccactgacagaatatattgatgatcatagtgaaatgttttctctctgggaatcaaggactagatatattctgaattaccgtctggaagaaaaaaaagttgaaagagcgttaacagaaacttatagatttatttcatgtatttgtgaagaatacaaccttcatcttgataaaagttacagcgaggaaagcttggaagatgaaaacgaactttaaaagaggcaattcgcctctttttatttttaaatttatatgacgagtaaaatactatgaaattagtaattgctgaaaagccgtcagtagcagttatcctaaatgtaaatatgttcaaagggacaaaaagaaagaatataggaaaactgaagagctatatccacaatgtggcagtgtattaatagaagggaacataaggttcggcaagtttattgcttgtagcaactatccaaaatgcaagtatcaagtatattaagagggataggcaaataaactgtgctttttattttttgttggaaaaactgagtagtctttagaattaactgcttttattttgatagtagaaaatgtttagtaataaaagaaagaacaaaattataataaatgcgtattagaaggagaatgcagatgtatataataataaaagcttttttagatgatttaattgatttttgctacaaaggaacagtcgaacccgatatgttggcaaaataccataaattttatttaaaattaactgataaggaattaaaaagcaaattaggacactacatattttcaaaaaaagctatacacttatttaatgttaaaagtagtaacaacgtttcctgtatagtaacgctaatacatgaactaagtcatcatattgattatatgaacagaggtacatctgatcatagtaaagatttttacaatgttcatattgagcttattatgacgttatttaaaatgggaacagtaagctataatgaatttattaacttaaaggattatgcaagtaattctaataaattaaaacgtttagtagaaaagggatactgtgtaacggaacagctagattatgaaaaagaaaaaaactggctaatagttaaaaactgttatgaagcatatgcgtacctaaaagaaaagaactatgtttacaacttttatattaagtcctggatgaaaaaaattaatataaatgatattgaaaaatcaaaaactgaaattctgaatacatgcaagaatgcaacgtttattacaagatctggatgtgaactgatttttaatttgggcgatgaaagtaaagaaaataatataccttttaaaaagacatctgaatctaacattacagacgtaactaaaaagtgtcctaagtgtggtgggaaactagtggaaagaacgggtaaatatggtaaatttactgcttgtggcaattatcctaaatgcaaatatattcagaaagacaaaaaggatgaaagtaggggaactggggaactatgtccgcaatgtggcagtaagttaatagagagaaacggaagatacggcaagtttattgcatgcagcagctatccaaaatgcaagtatgttaagaaggatatgtaaaataaattgtgccttttattaaaacaaaatatgctatagtgattattataattagattggagagaaaagaatgaagattgtaggggtaagattaaaaaaaggaattcataaaccgattaaagatactgcaaaaatttattattttatgtgtcctataaaaaatgtgggtataggagattatgttcttttggaatgtgatggtactgataaaataaatatatttcaagtggggctaataattgaagaacatgataatactcctgaaaatacagagctgtatatgcctttttcgtttgttgtttcaggatttcctgtaaaagattttttggccagatgtgataaagttgcagaaatgcgaaaaagacaaataaaaaaaatagatgagataatcgcatcagatcctataaaatataaaaaaagagtacctaaaaagaaacccaggaaaaaaagtataaaaaacagattatatgcactaactgtaaagtgtcgagataacgaacttagtgaggaagagaaaataaaagttgcaagtgaacttttgaagatatattacattcttatggataataaaactccaagagaaaagagatcgtcttggatgagcagtgtcatgggatgtgatgttgatgaagcaaaaaggtatatagaattggttagaaaacatccaaaataaactttcgatcatgaaagtactgataaaaaattggaagtacagataaggaaaatcataatgaaaaaatagaattagacccagaaaaaagagattaagctttattatttaatctcttttattttggattgtcattaagtagaaaagatatatagaattttttgattaactagtgtagatttatttactggatagttaaggattttttcattaactatcctcttggcataatgaagaaaagagggagaaagaaatgaaattaaaaattgcctactgtagagtatcgactatgaaacaagcacgtgacggtgttgggattgatacgcaaaaaagaatgattgctgaacatgctttagcaacaaatcttataaaaagtactgacgagttaagtttctttatcgatgatggtttttcaggtggtgacctttgcaggccgaaaatgaatgaactattaaaagaaataaaaaatgggaatgttgaaatgattttagcatacgatcttgcaagaatatccagagatgtgcaggacagtaatttatttttaaagttgatattaaatcatggtattaaactcatttgtctatatgatgatgcaaaaataaatactgcaagcgacagatttagtacaaatataaaactgtcaaacaatcagtttgaaagagagaggacaatagagcgaacaaatgacgggttgatcagcatagtggaaagcggtagatatccatgtggtggtaaaatgacatttggatggtatagggacgaagataaaaacattcagcttgataaaaaagtatataatataatcagaaatgcttttaactacgtgattgaagaatgggaaacatcagatgttagagattatttaaacaaggctcaaaaaaaaacagtttactacagaatctgttaaacagatgattaaagatgaacgatattcgggtgttctcttgtataaaggaaagaaatatacaaacatagtgccaccaatagttacaaaaagtatacaaaataaagctatagacagtttaaaggtaggacgttcgagaaagaattatcgatacatatacgataatattaatcttagatgatttaattgaagcgaataaagatttctggcctgaattgaaataagatgttaaaactatttaaaaagaaagaaaaacaaaataaagtactatcttcaatggctaacggaaaaagtgtagccattgaagatgtaccagatgaagttttttcaacaaaaatgatgggtgatggaattgctgtaattccagatgatggtaaaatttatgcgccatgtaatgggaaaatctcaatggtgatggataatacgaaacatgctttggggattgaaaccgaagatggtatggagttattaattcatgttggcttagacactgttaatttaatgggtgagggttttgccactcatgtatctgccggtgacagtgtagaaactggtgaattattaatttcttatgataaaacagattttgtgactaaaggaatcaatgatataacaatgttagttattgttgaaaatggtggtcatgaaatcacaaaatataatattaatgaaaatgttcatataatagaatctcctttaatcgaatacaaataaaatcacatcaaattgatgtggtttttctttactgtgataaatttttttctaatttagttattgattttgttttacttaaaatattgttataataatacatgtagaggtatgatatgaaattagaagaactagttaataggaattatcaacaacttaatgataatgatttatatatatggaattatattattcatcatcgtaaagagtgtgagcgtttatcgattgatgaactagctttaagatgtagtgtttcacgaagtactattttacgcttttctaagcgtctgggtttaaaaggatacgctgaatttaaagtttttttacggatcgataatcaaaaaaatgataaaaatgctttaacagataatatctttaatcattatatagaaactttagaacaatatcgggattatcattataaagaaattgtacaaagtatttatgaagctaaaaatctttatgtttatggaactggggtaattcaagataatacagcgcaacatttaaaacgttcattttcaatggtgaataagttatttttagacattgatgtattagcagattttgaggcttatattaatttgtttggtagtaatgatgtttttattgctatttcttatgctggtgaaaatcaacgcttattagattatgtttatcgtttaaaagctaagggagtcattgttgtggctattattgctaataatgattgtactttatctcatgtggccgattatagtctgcatgtaaagacattaccagtcatgacaaatcaagggcgtcgtgaagatctggtggggaactattttattttaattgattttattattgccaattatattgaatatgctaaaagtagaggaaatgaataatgacattagataaattagtagaagataattaccatcaattgaatgaaaatgacttatatatctggcaatatattttacatcataaacgggaatgtcaaagaatttcgattaaagatctagcacgtaattgcaatgtatcgcatactagtattttacgctttacaaaaaagctggggcttgaggggtttagtgaattgaaggtgcatttgaaatgggacttggcgcaaaagccaaatttcaaaccacgaattatagacgatacttatcatgaatttattgaaacaatggaacgaatgaaaaatcgagatttaactaatatcatggaaatgattgaaaaagctgaacgagtttttgtttatggaactggagttgttcaagcaaatatggccggtgaactgcggcgggtttttctttatacaaacaaggtttttcatgctgtaggtaacggaacggaaatcgatacaatcttaaataatgtaactaaaaatgatttgtttattattatttcattatcgggcgataatgaaacagcagtaactttagcacgcgctttacgagggttacatattccaagaattggaattgctaaggttggaaatactttattatcaaagtattgtgatgatatgattacttttagatatgaaacgtttaaagtagggatgtcagatattctttatggtagtaccgcccacttctttattatttcagattttttatttttgagatacttagaatattcacaagagaaaggatagatgtaaagaggatgattaaatgaaactttaagagttatgaaaatttagttaaagataaaggccctttaatggctaattatgctttgatgggagatggtaaagttattgatggtgagctttacgaagaattacgaggtaccgaaggatgctgaaaatggcgatactattcatgtggtcgtagaagttcaagataatggtaaacatcagttgaaacattgtcaaagagttattattacagttaaatagttttatagcagctatattatttatatagctgctttttgttgagaaataaatagcttataaatgttttaaaggacgtcagtaatatgacgtccacaatgtttaattaatctttttttggtttatcagttactaattcttttaaagaactagctaaaccggcaataccttgaatctcactaggaataataatttttgtggcttcacctttagataactcttctaaggctttaaacccttgtaatgttacatatgcactgtctgggtttgcttgattaatatatgtgatacctttggcttgggcttcataaactaatcttaatgcttctgcttctccttcagcaattgcaattttagcttctttatctgctgttgcacgtaaaatcattgattctttatcaccttcagcatttaagatagcagcagtcttttttccttctgcttgtaagattgcttcacgtctttcgcgttcagctcgcatttgtttttccattgcttcttgaatatcccgaggtggaataatgtttttaacttcaacacgatgtactttgattccccatggatcagtagcctcatcaagaatactacgcattcttgagttaataatatctcttgatgtcaaagtttcatctaattctaaatccccaataatatttcttaatgtagttgctgttaaattctcgattgcgttgattggtcgatccacaccataagtaaatagttttggatcagtgatttgataataaacaacagtatcgatctgcatcgtgacgttatctttagtgataactggttgtggtgcgaagtcaacaacttgttcttttaatgaaactttattggcaactcgatcaaagaaaggaatcaagatgtgcaatccaacattacatgtacgattatatgctccgattctttctacgacatatgcccgtgattgtggaacaattctaattgttgaagcaatgatcgtaattacaataattcctagaaaaacccataatacaatagcgacaattccgtccataatatttccctctctattcttctatttttttaacaactaagtgagctccttcgattgccatgatttcgcagtactcaccctcgttaatagtgttattatcaacacttgcagctagccatgatgttgacataacttttacttcacctttagtatctgcagtaatcgtcttagttacaagcccatgcttaccaattacacgatcgtaattggttttttcaatatttgttcttaaatattttttagcaataggtcttgtaacaaagattgcgatcgttgtgacaattacaaacaaggcaatttgaattgcttggctagcccctaataaatcagcaattagggcaacaacaccacctgcagcaaaccagatgcttactagatcaatagtaataatttcaacaattattgctacgatgataatgcctaaccaaataggtatcatttataatccccctccttaaagatccactaacagaatctgatgtattacatcaaacttagcagtatactttacacagttgttattgtctaaatctaaattatattcttttgatagttcactaataaagtttttatttgaaattcgtccgtagctttttccaatggaaattctatgcaattgatcttctggatataacgcatcatttatttcttttttaccaactggcttaattcccaaaacatttttatttcgatcgattcctaataaaacaaaatctacttcttcaaagtgccgacaggctgctttatttaatgttagattggtgctgtagatagtaactgtttttttagcaatatcattagttgaccattcaaattccataagtatcaccctttctatcactattatattataaaaattatttttattcaacaaaattattgaaataaaaaatagcagttatttctgctatttagcaacactatagaaattagtagtttgataattataaatgatatttgaagtgttaaataactgtccgtttgataaatgaatattatcattgatcataatggctggatcattttcttcaagttctagtaaagcagcatcttctttgcttaattttattgcagttagatatttatcagcaaaaccaaaagagatttttaaatcatcttttaaataattaaaaattgatccttcagcaatttccttacctaaatagggtacgatttccttattataatatgttcgctctaaagcatatgggataccgtcgacaatacgaagacgctttaagtaataaactggagttccaactttgcagttcatctgttcacttaacttttcatcagcttcaactatttgaatatctaataatttattaatgattttattaccgggattatccattgtcaccccacgggtcgagttaagatacactgttccttttttctttggggcccgaacaaacatcccgcttccttgaactggataaataatgcctaaattcattaatattttaattgcattacgaattgtattacgactaaccccatattcttcaatcagtttttcttcagtaggtaattttcgagtctcttcaaattcttcattcattatccttttttgaagatcatttacaatcatttcatactttaacatataatcacctcaaaactcattatatcatattagtcaagtttcacaatatttattggtatgaatataatttattctatttttattgtgaaagcgctttacattaattcttcattggaatataataaatttgtaccaataaatttggaggagaaaagatgaagagaatattgaagggagcattagtagctctaatggttgtttcatcaactattggggttaaagcagagtcgaagatttcagccgaagtacaaagaattattgatagtatgacaccggttgaaaaagtcgcacaaatgattcaggcggatactcgctggatcactccagctgaagtggcggagtataagattggttcaattcttagtggtgggggagcagcaccaactagtggaaatgaattaagtaattgggtaacttcagcaaatagttatcaaaaagcagtaattgatagtggtggtattccattgttatatggaatagatgcggttcatggaaataacaatttgtatggagcgactatctatcctcataacattggattggcagcagctaataatactcaattagttgaacaaattggggaggctactgcaagtgaagttagagcaatgggagccaactggacatttacaccaacattaggtgtacctcataacgaacgttgggggcgtacatatgaaacttttggtgatgatgttgaacgggtaactaatttaggtactgcatatattaaaggaattgaaagtgatggtgatactctatcgtcagcaaaacattatttaggagaaggattaactactaatggagctaaccaaggtaatgtagagcttagtgatgctgattatcaagatctaatcaatgcaaatatgaataatccaatggttaaggaacttttaacaccttataaacaagctattaaacaaggaactaaatcaattatggttacctataatagtatcaatggtaaaagatgtcatggaaataaggacgttgttacaacgttattaaaagaaaatcttggttttgatggcattgttattagcgattataacggtcttgatcaaattgagaatcaagcaacttataaagataaggcaattgcttgtatcaatgctggtgttgacgtcttgatggtagcagaaaaagatggttcaacaccacgctggaaaaatttatataatgctttagttgaagctgttaatgaaggaaaaattagtgaagaacgcttaaatgatgcagttgcaagaattctaactgctaaagaagaattaggatttttagataatccttcaaaagcatatgctgatgaggcagatcaagctaaatttggtggtagtgaacatcgggcattagctaaacaagcagttagtgaatctttagttttattaaaaaatgatgaagttaatgctggtaaaacagtgatgcaggctttagcagatatggataatatcgtggttgctggtagtgctggtgatgacattggtaaacaatgtggtggttggacaattacttggcaaggggcaactggaaatacaacacctggtacaactattttcagtggtttaaaagcagcgatggataaaaagggtggaacaatcagctataatgctaatggtgtatttacaaattcggacaataaagttgatgcagcaatagttgtagttggtgaagacccatatgctgaaagtaatggtgatcgcagtgctggacaattaaaattaccagctaatgatattagtacaattaaacggattgaaaatagtcatcctgatttaccgattattttagttttaacaacagggcgaccaattgcaatggctgattatgttaatgatgatcatatcaaagggattgttaatgcatggttaccaggtagtgaaggtgatggggttgctgatgtactattaggtgataaagattttgtaggaacaaatccaattacttggacatggtatcctcaagatattactagtaagtatgatgattcaagcaaagtattatatccggttggatatggattgaaaaaagctcaaaaaaccggtgattttacagcaccagctgatcctaatgtgatagatttagcgaaaactaatggaaaattagaagccgaggcgtttgtggatgcacacagtgaaattaagttagaaaataatggtacaactgtagggtatttacaagatggacggcatatgacttataaaattaatgtgccagaacaagcagcatataaattaactgttcaagcagcacgtgaatatgcagcgacaattgatggagcatttgaattatatttagatgatgaattggtactagaaaagaaaaatacaccaattgtttcaacgggcagctggactaagttcacagctcaagagatgacagctttggttagtttaaaagcggggatacacgaacttaaacttgtagcacgcgataaagattttaatattgattattatatttttgaaaaagctggtgattatgttggtccaatcattcctgatgaagtaacaaatgagggaactggagcaatgttacaagaaggagcagttgaagtaagcatgtcttcttctgaaaattcacaagatatggcttggtataaaggtgaatttgagatttctaataaaaatgcaacaaaagatcctcttgatttacgtgttgcagatgattctagtcaaacaacaattgttgtaaatgaccaaaaaacatatcaaagtgttttaggaatgggaacttcaattgaagaatcaacaatttacaatttattaaagatgactgatgaaaatcgtcaagctttcttaagaagattattagatcctgttaatggtatgggaatgtcgttaatgcgggtaacagtgggaacatcagattttacggcacaagacttctacacttattatgatggtacaggaaaagaattagatggtaaaccagattggaataatgttactggtaaaggatttagtattcaaaaagataaagatttaggaattattaaagttattaatgagatgcaggctatcgcaaaagaattaggagtagaagataatctgaaattctttgcttcatcttggacaccaccagggtggatgaagttacctacttcaagtagtaattcatatgaggataatgaattattattgaagggtggtaaattaaatgatgattatattgatgatttagctaaatatatggttcgttatgttgaagaatatcaaaaatgtggtattcctatctatgcaatgacgattcagaatgagccattattagaaattaattatcctagttgtgcaatgacaggaacccaagaagcaaaaattgctaaagcaatcaaagctgaattagcgaaaagcactgtgttaaaggataatgaaaaagaagttaaactatgggcgtttgatcataattttgatggtgctgataaatttatggctgatttctttaaagaagctggtgatcaattaaatattgatggtattgcattccatccttatggtggtaatgcttcaacaatgggttctttctatgatagatataaagatcaattaagtatgaacttaacggaaagatcagtatggggtactagtggtgctaatgatattattacttggttaagaaacggttctgaaagttataatagctgggttacgatgttagatagtaatgttggaactcatcattgggttggaactccagatccaacgttatttgtgcaggatgctaataatcctcaaagatattgggctactccagaagtatatatcatgtcgcaatttactaaatatgtaaaaccgggatatgtccgtgttgatacaaataatggttctagttcaactgtaacaaacgttgcgtttaaagatcctgaaacaggaaaaattgttatgattgttgcaaaccgaagtggtactgatcaaaaattcaaagtaatgatgaagggtgctcaatttaatgcggtattaccggctggtaatgttgcaacatatatttgggatggtagtgatattgaaataaatgcattagatgttccaggaacatttacagctgataaatgtagttcagctactaatgctaatattaatacaacagaccatattattgattatgtaaataaaaatgcgagtatagattatttggttgatgtaaaagaagccggaacatataatgttatgattaaagttgcttctggtgaagattgggaaaataaaacagtaaacgttaaatcaggtgatacagttgttggtactactgtggcacaaagatttaatttctggggtggtgaatggcaagattaccgttatatccaagctcaagcaaatctggaaaaaggaattcaaactctaacgatcgaattgccagatggcggtatgaatctaagtgaaattaagatcaataagacaaaatacagccatgatgtgcctgggtacattagtgctacagattactgttacggtgaaagaattattgtagaagatggaaatattggtttctttggtgagtacgaccgagttaattatcgggttaatgtacaaaaagctggcacttatcaaatgaagatgaactatgctagtgatggagaagcaaaattttggatggatttaattcaaaatggtatctctgcttcaattggtgaagcaacactctctagtactggtaacgatagcacttacagtactggggtagtagagattaatctgcctgaaggtgaaagccaaattagttttgtcccacaaagtggtgtaagttttaacttgaaagcattatcgtttggctcatatattcaaatttctagtgatgaattagaagaaggtaaattagctggtaaagaaattactgttaatttaaaagatggaaaatttgaaactgatttaaatcaagctaattgggtggttgaaggattgcctgcaggtattacttattctttaaagagaataaatgatacaaaagcagtaattatattaaaaggtaatgaagttgtagattatgatagtaatcttacagtgactgttaaagttgatgctggtgagattggtgatactggttatagtttgagtgatagtgtaatgattgctgcagttgatgatgacgaaacattattagatattggtgatcttgcttttggaacaactgaatttgatttaatgattgaaggcggaaaattcaatcaagatttaaaagtaaatgatcttgttttaagtgaagaagcagctaattatatgactgttaaagcggtaaaagtaagtgctgatggaaacaaagtaacagtaacattagaacgtaaaaatactaattatgaagatgttgcagggacaattagtataaaatcaaacggttatagcgatggcaacgtcgatttaacagcaaatcttaaattattaaaaacaaataatctaccagatagtattgatgttggtgatgttgcggtaggattaaaagaaagtgatgcatatcgtaaaaaaggtactttggttaatggtgctaagggagattatattgacttctatttgaatattaaagaagaaggaaattatgtattgacatataagattaaagatagtgaagcaattactaatggtttaaaactaagtggtggtttaggattggctactgataatcttggcagtgtttcttttggtaaatattggggaaatgcacaaggttatgcacagatgttgaatttaaaagctggtgaacagaatttaagatttgaagttaatagtgctggttttgaattaactaatttaaaaatcgaaaaattaactcaagcaattgaagttagtgatacgcttgatcaaacaacgacgataacggctgacaaggtagttgatggttctaaagaaattggttgggggattgaaggttcaacaactaaaaatattggttttggatctgcaggagcttatcaagattattatcttgatgtaaagacggcaggattatacgatgtaaaggttaattatagtcatgattgcggtggcgatactaaagctgttatcatgacagtagatggaaaaataactgctactttgggtgaagttactttaaagaattctggtggctggtcaaattggaaagatagtgacacgattcaaattaaattagaagctggtaaacaatttattcgtatttatgatgatctagacggctttaattatcgtaatttccaattaacatttaaaggggaacaggatgtcactgctccagaaattacgggtaatgatgcagttatctatgtaaatgatgcaacagatattaaagatttactaggattaatagttactgatgatgttgatggtgatttattagataaagtaacaattagtggcgaatataattacaatgttgcaggaacttatacaattacagtgactgtaagtgatgaagctggtaatgaaacaagtaaagaatttacagttaaagtagttgaacctgcaaaattaattgttgaagataaagtattaacagttggcgataaatttgatccattagctggtatacaagttttagatgttgatggtacggatattactaaaaatattattgtaattagtgatggtgttgatacaagtaaagcgggaagttatgaagttatttacagaataactgatgctttaggtaatgaagtagaatttagaagaacggttgaagttaaggacatcgaaccagatgttaaaccagttgatcctgatgagcaaacaccatcagataatagtggtcaacagactattccaggacaagtagttgaagcagctaagactagtgatgatgtaaatatcacgggtatgtttggtatacttgtattagctggattaggatggattggatcaagaaaaagaaaattttgtgattgttagataaaactctctctccttgcgataaggactcacattgtgggtccttatctttttttataacagcatataacagttgacaatcagttatatactgttatatactgtttgtgaagaggagggagaagatgaagattatcataaataattcatcgatgcagccaatctatgaacaacttgttgaacaaataaaagctcaaatcataaatggtcaattgcatgaaaatgatgtattaccatcagttcgtgcgttatcaaaagaattaaagataagcgcattaacagttaaaaaggcgtatgatcatcttgaaacagaaggatttacagcaacgattcatggcaaaggtacttatgtaaaaggggcgaatcaagagttgttgttggaggagcggcgcaaagaagtcgaaactgaactggaaagtaccattgataaaggaagacgttacgggatgaacgacgatgagataaaagctttatttaatttgattatggaggaataagatatgttagaactaattaatgtgcaaaaagattatggacgttttaagcttaattgttctttagaagttaaggctggttgtgttactgggctgatcggacaaaatggtgctggtaaaagtactacttttaaagctgttttgggtctgatttcagtagatagtgggactgttaaattatttagcaaagatattaaaagattaagtatagaagataaacaaaatattggggtcgtgttatcggattcgggatttagtgaatatctgaggattgaagatatcatccctattatggaatcactgtatcgtcattttgataaacagatgtttattgaaagagttcgtcattttgaattaccattaaacaaacaaatcaaagaattttcaacgggaatgaaagtaaaattaaaagttttgattgctttatcacaccaaagtaagttattgattttagatgagccaacagcaggcttagatgttattgtgcgagatgaattgctggatatgcttcgtgattatatggaacaaaatgaagattgtgcaatcattattagttctcatatttccagtgatttagaaggactatgtgatgatttatatatgattgatcagggtaaaattgttatgcatgaagaaacagatgtattattaagtgactatgcgattttgaaagttgatgaggaacagttttatgaattagataaacaatatttgctttgtcaaaagagagaaagttttggataccgctgtttaactaatcagaaacaattttatttagaaaattatcctgacgtggttattgaaaaaagtagtattgatgaggtaatgacattaatgattaggggtgaaaaataatgaaaggcctatatattaaagattttaaattaatgatgaatcaaaagatgttttttatcgtaattgcagcaatggcaatattttttgcggttacccagacaaatatattttttgtaattagttatgctacttttattgccgcaatgttcgttataagcagtattagttatgatgaatttaataatggcaatgcgtttctctttactttaccagtgacaagaactggatatgtcaaagaaaaatatttatttgcagctactttggcgaccggggcatggctggcagctacaattttatcgatagtggttgtttttattcaaggaactgaggttattattttggagtggtttttaactgcggcaatgatcttgttagtggcattaatgatggtcttaataataattccagttcaacttaaatttggtcaaagtaaaggaaatgtagcaatgctgttagttatgggtggtgcttttgcaattggctatttagttgtgtcagttctttcaaattttggaattgatgtatttgcgatgattgatgcattaagcacgattggattaagcgggttgttgatgattttactcttaatggttgctggtgcggggataatatcgtatttgattagttgtaaaattatgacagaaaaagagttttgatgataatgagcaatgaaaaaaatattaaagatattagtgattgttatctttgttactagtttactaggatgtcaagataagtatcatgaaacatatactttgcggtattattatattgaaggttgtgctaattgtgaattttttacaaaaaaagggattcctctaatcgaaaaagaatttggaaaacatatgaagatcgttaaatataatatggatgatgcaacttcgtttgataaagttaaaaaagcttatgatcatgatcttgaacagcttcaggattttgattatgatcaatatggtgttgggccgtttttagtcctcgagaatcattatgttcaattaggagtttatgatattgaaaaatttttaaataatttaattagagcagttagtggtgagaaattgatggcaccagaaaaaatcgaaaaatactattattttaaagataattaaaaaagtatctattcttaatgagtagatgctttttgcattagtatacatttagataattttgggttataataacgagtgaggtgtaatatgaaaaaaatatttaaaatcatgataaccttggtactcactgtaagtttatttggttgtcaaaaaaaggaaaagaatgtttatacagaaacatatacattacagtacttttatttagaagggtgtcctaattgtgagaacttcacaaaaaatggtttacctttaataaaagaagagtttggtgatcatatgaaaattattgaatatgatatggatgatacagagactcttacagaagtaaaggctgcctatgatgaagtaatcaatagcattattgattttaatcaagatgattatggatttggtccttttttagttcttgagggatattatgctcaattaggagttagtgatgttgatgattatttagaaaatctaatagcagcaataaaaggtgaagaattaaatgaacctggagagattgatacgtattattatttaagagatggaaaggtaaaggaggaataaatatggccacaccacataatcaagcgaccaaaggagaaatagcaaaaacagtattgatgccgggagatcctttaagagcaaaatttttagcagaaacttatttagagaatgtaaaacagtttaatacagttcgtaatatgttcggatatacgggaacttataaaggaaaagaagtatcaatcatgggttcgggaatggggatgccatcgattggaatttatagttatgaattatttagtcagtatgatgtagaaaatattataaggatcggttcatgtggttcttttaaagaaaatgtgcatttaagagatattattattgttcaagggtgttgtacggattctaattttgctcatcaatatgaattaccgggtacttatagtgctatttctagttatgctttattagagcgggcagttaatgaagctaaagaaaaagacgttgtttaccatgttggtaatgttttagcatcagatattttttatcatgctgatcaaggttcagttgaaaaatgggcatcaatgggttgtcttggagtagaaatggaatcatatgctttatttgctactgcagccaatttaaataagcgtgctttaacattgttaacagtatctgattcattggtgtcaaatgaagaaacgtcccctgaggaaagagaaaagacatttacagcgatgatggaaattgctttggagattgcttaatgaagcaaaagtttgcgttttttgattatgatgatactttgattcatggtgattcaggaagagcactattaaaatattatttaaaaaaacatcctttagcagtatttagactgctaaaggtagcagttgcttttcctttatcgataattgggttagtaaaatttcaaacggctaaaagtgcctggttgtttccaatggataatctaagtgatgaagagcttaatgatttttatcaaacatgtcttattcctaaatattatcctaatgtagttgcagaattaaaagataaaaaaaatgacggttatcttgtttatatctgttcagcatcgattgaaggttacttaagattttgtgatctgccggtagatgggatattaggaacgaaaacagaggtaatcggaggcaaatatacaagtcgaatgattggtaataattgtaaaaacgaagaaaaggtaacacggttaactgcggttatagcgaaattaggggttgagatagactatgaaaattcatatgcttattctgattcaatgcacgatattccaatgttaaaaatggttaaaaatagaattagaataaataaaaaaaatggagaaatgactccattcataattgaagagtagattactactcttttattttgtatctaaatcagtaaatagtagcataatattaataataccggcaataccaactaaaatatatattaacattgataaaaagctatcaacaccaaatagagaatcaactaggttgaaattgaataaaccgattaagccccagtttatcgctccgataattgttaatactaatgaaattttttgtaatatattcattatcttcatcctccttattaaagtgtatccattagaaatatctttatacataatatttatttttaaacatatttattattgggggtgtaaatttgaaaaaaatatatattggtattgccgcggcagttgtgatagtaatcgcagcgttaactttctttaaaatgaaagatagttctttagataaggtgattgaaaaggttaaggcttatgataaatatgcacttacttgtaatatggaaatggttgaaaatgatgaacttaaaagttatctagtcaatgttagttatttaaaagaaaaaaagaatgaatattataaagtagaattatatgataaatcattgaatcaatcacaaatcattgttaagaaccctgatggtgtttttgttttaacaccaactttaaatcaaatctttaaatttcaaagtgagtggccgaataattccccaaaaccatacatctatcaatctctaattgaattattagaaaaaggcgaagtggaaaaaataaaaacaggttatcaagttaaatgtgaagtgacttatccaaatgattcacgggtggtagctcaagaaattatttttgataaatcattagcgccaaagcaagtaaccgttttagataaagacgaagctgaaataattaccgctgattttactgattttaagacagatgttaaattgggaaaagataattttaatgagaagaaggttttagaaaagagtactaatgagtattctaatgtttctagtgagttaccattatatccagttgccttaatgggaagcactttagatagtgaaaaagtttcaacgattgatgggacaactaaccatattttaaaattcactggagataagaattttacagtaattgaaacaccggtaactgctagtgaagaagttgcagttgaaacggtaagtggtgaagtaattgatcttgttgatggtgtggcattttataatgatggtcaattaatgatgatgaaatcaggtgttttatgcaaattgtattctcaagatttaaataaagatgaaatggtcaatgtaatcagtagtatgcagacatcgagtttaaaatagaggcaaaatgcctctaatacataattatgaaaatatttgaattatcaattagattggattatacttagacaagatggaggtgtcatatgagtttacatcgtgatacatatgcagaaattaatttaaaatatttaaaagaaaatattgaaacaacatataaaaaatttaaacgtccgttaatggcggtaattaaagcggatgcttatggtcatggatatcgagaagtggccacatatattaaagatattgaatatcttgagatgtttgcagtagcaaccttaccggaagcaattgagttacgtgaattaggtattactaaaggaattttaattttaggagctgttccaacttctaaggaagaaattgatttagcaattaaatatgatatttctttaacaatgatctccttggattacatgcatcatctagaaacattgatagatcaacagccgttgaaaatccatattaaattagatacgggaatgcatcgtattggcttaactagcaaagcacagttggatgagatgttaaatactattgattacaataagtttatcttagaaggaatttttacgcattatgcaacagctgatggtgaacaggcagcttttgaccagcaaagagaacttttttatgatttagtagctgatcataaatttaaatatattcattgttgtaatagtgcggcaatggcttatcatcatgatgatcgttctaatttagggagaattggaattattatgtatgggatcgatccagctggtaatgaaacaaaggaatttaaacaggtaatgtctttatattctaaagttgctctgattaaaaaaattaaagctggtgaccgagttggttacggcttgacttacactgctgatgaagatgaatatttagcaacgatcccaattggctatgctgatggattgattcgtaaaaatcaggggcggaacgtttatattaatggtaaatattttgaaattgttggtcgtgtttgcatggatcaaataatggttcgggtagatgaaacgattaaagaaggggataaggtagagatttttggagcgcatataagtttagcgagcatggcaagagaacttgaaacgattccttatgaaataatttgtttgattactaaacgagttgaccgtttatatataaaataaaaaaacagtacaatgatgtaaaatctaaatgttagcgagagactgactataatagatacatcattatgctgttttttatttgtacaattgacttaatcggtaatatgataaagcaccagtcttagctgttttgacttttcctttttcatatactaatgtttgtggtaccgtaccatcagtgatatcgagtttttcttctagccaagtagtataatcactgtcaccagaaacgtctacatagtatagagatttactacgatttttttctacaaatgtggtcatggtttgttgatatgataatgttgtattatcactattatttccgataactacgacaaaactatccttatctttaactttttctactaatgcactttgagtaatcgttgtgtattcaacatgggttattttccgatatacaaataatccaatgaacactactaatacgattccaaagatgctaatttctttccacaatttctttactttttccatgattagcctccataatatacctttatataataacaaatatttcagctaaaaacaatatataataaagggatatgatgtgacatatcccatagttaaacttatttatgttttaaagcataattccaagtgtcgcgacacatctcgtcaattcctttggtagctacccaatcaagctcttccttggcgcgagcaggattagcataacaagtagcgatatccccaggacgacgatctttaataacgtatttaacttttacattattgactctttcgaaagctttaactaaatcaagaacactatatcctgtacccgtaccaagattacaaatatggactccaggattagcataatgttcaattgcttttacatgccctttagctaagtcaacaacatgaatataatcacgaacgccagttccgtcatgtgtatcataatcatcaccaaatacacctaagcattctaattcaccagttgcaactttcatgatatatggcattaaattgttaggaatccctttaggatcttcaccaatcaatccagattcatgggctccgattggattaaagtaacgtaacaatgttactgacatttctgggcatgcatgttgaacgtcagttaaaattctttccatcattgctttgctagtaccgtatgggttagttgtttcacctaacttacaatcttcagtaattggaacggtttctgggtcaccataaactgtagcactagatgaaaaaacaatttgattaacatgatattttttcatcattttactaacgatcaaagttgttgttaagttattagtataatattcaattggtttttcaacagattctccgacagctttaaatgctgcacaatgaattacggcatcaagtttattttccttaaagacagcttcagttttttcctcatctaaaatattaaattcataaaattttacttctttaccagtgatttgtttaatataccccaatacttcaggtcttgaattagagaagtcatcaatcacagtaacttcataaccagcatttaataattctacacaaatgtggctcccgatatatccggttccaccgcaaacaagtacgttcatcactatacctcctaatatgttttaataataccatttttaactttttaataaaagggattagataaaataatcgagcatatcattgaagatatgctcgacattttatttattgagaactgctttaactatgttatcgctagcaaattcataatctaaaaattccatttcaaagacaccttgaccttgtgtgattgaacgtagatcaacggcataattcatcacttcactcattggtgcttctgcaacgattttgattagaccgtcatttaaaacatcactgccaattacccgagcacgtttagtattaaagttactcatgatgtcaccagtgtattgttcatcaacgaccaccttcattttcatatatggctctaataaggcgggacttgcttttgggatagcttctttaaagcacattgcagttgcagttttaaaggccatttccgatgaatcaacgttatgataggcaccatcaatcagagtagctttaatgcctaaaacagggtaaccggctaaaacaccacttttaacgctttctattaatcccttctcaactgcaggaaaataagatttaggaactgcaccgccaaatactttttcttcaaaaagatatgattgactgtaatcgtaggtaggctcgaaagtaatttcgacttcgccgaattggccatgaccacctgattgttttttgaatctggttctttgggtaatgctctttttaattgtttctcgatatggaatcttgatattttctaaagtcgcttcgactttaaatttgctttttaatttatttaacatcatatctaaatgaatgtctccaattccatagatgcattgttgttttgtttcaggattactttcgaattttaaagtagggtcttcttctaagagtttattaattgcatttgcaattttttcctcattacttttacctaagggaacgattgctttaccgtaatatggagttgaaaattcaatctctggaacaataatttgataaccagcaatgcacaatgtatcattagtttttgaataactaagttttgtaactgcgccaatatcaccagcatgaagacaatcgacctcgattaaatctttccccctaggttgatatagtttagcgattcgttcgacttctttttcttttacattatataatgaactaccgctataaagggttccggtaacgaccttaaacaatgtagttcggccgatgaaaggatctgcaattgttttaaagataaaaatacttgcaggaagactttcgtcataaccgatgatttcttcttcatcagtgtcgatattttttacgattaatgaatttgtcatgtcaccagcagcgctaaagaatgcaacgattgaatttaaaataatttgaataccaatttgatcagttccgcataaaacgggaataagagtgcgctccattacccctttacgaagtgcccaggaaatttcttctttcgtaaatggttcttcattaatatacttttctaatagttcatcactggtattagcaacggcttcgtcaatcatttctttaattggccgaacttgttccatcaattcaataggaatatcagttgccttggtttgctctccatcaaaaattcgtccctccattttagctacattaacataaccgaccattttattattatccatgattggtacttggatcggagcaatggctttgccatacgtatcctttaattgttgcagtttagttgcatagtcactgctagggttatctaatccgttaatatagatgattttggctttatctttagctctaaacatcgcttgttttgtaccggcactgattcccgctgaagaaggaacgacgatcaaagctgattcacaaacacttagagctgcttcgcattcaccaacaaagtcaaaaattcctggaacatcaactaaattgattttacagttattccattcaacaggaataacagctaaattgacagatgactgacgttttatttcttcttcactatagtcgcttaaagtattgccttcgctaatacttccggttcgattaatgatgccgctgcgatatgccattgcttcaacgatgcttgttttaccgcatccagagtgccccaagacagcaacatttccgatttcgttcgcatgataagttctcataaaataccacctttctataaatgaacttctttcttttattttatcataatgacagaaaaaattattgtaatataataataaaaaagagcgcttacatatgttggtttgtaaatttcttttagtgttataatgaattgtttattttgtttagagctttcaatgcatacacgtgcgcagtttttcctaaaacttttaattaaagacttatttttggcaagatattcaattaaaaggagtattgattattgaaaaatagctaagcaagtaaatgattagattactttttcatttttaacatatttagtattatcatgctgagtatttttattaatctgttcagtctaggattttatcaaaaaacagttaagtcaaatatagttataaatttttattttacctatctctaaaatttatggagtgattagatttcaagttgtttccaatatgaatagttatatgaggatattttatctatttaataaatgctcattataaaatgagttttaacagaaaaaattaaaaaaattgcaaaaaagtgttgaccttttgtttgataattgttatatttatatggcagtcaacgagacactggaggtttagctcagttgggagagcatctgccttacaagcagagggtcagcggttcgagcccgttaacctccaaagatagtaccaaggtgcgacaatagcaagctgccggttctttttttatttacggatacctctgcgtatccttttttctttgttctaaaccgaagtatgccttacttataatcctttaaattaggactactttgtagtataatagatatggtgataaaatgaaaattaaattatattttggacaagaagatgctatcaaaaaatcaggaattggtcgtgcttttgtccatcaaaaaaaagcattagaattatcaggaatcccttatactacagataaggatgatttggattatgatattctccacattaatactgtatggcctgatagttttaagataataaatcaagcacgaaagtataataaaaagattgtatatcatgctcatagcacagaagaggattttaaaaattcttttatgttttctaatactgtttcaggggtttataaaaaatggctgatcagtatgtatacaaaaggtgattatattgtaactccgactccttattcaaagcggattttagaatcttatggaattacacttccaattaaagcagtttcgaatggtgttgatttgacacagtttaatcctagtcaagaacaaattgaatcgtttattcagcaatacaaaattgattctaaagatgttgttattatttcggtaggttggctatttgaaagaaaaggatttgatacttttgtatcggtggcaaagaaattgcctgagtataaatttatgtggtttggtgatattaaattatcacgtcctacaaaaaagattaaagatttactagatgatttacctcaaaatgttattttaccaggctatgttagcggtgatataattaaaggggcttatggaagaagtaatatattctttttcccatcaagagaagaaactgagggaatagttgtattggaagctttggcaagtaaatgtaatgttttactgcgtgatattcctgttttttcagattggttagaaaatggcgtgaactgttacaaaggtaaccacatagatgattttgttgaaatcattaaaaagatgattaacggagaatatccttcattagttgagcaaggctataaagtagctaaagagagagaactatcaaagatagggaaagaattattagaggtgtatgaagaaacgctgaacctctaatatgaggaaagcttatggataagaaatctaataaaaaatatttccttaacattattttaattcttgttttaggggcaactgtaatttattttacaatgaaagatgatttacatgcttctttaagagcattaacaacggcctcgcctttatggattgttatttcctttgcattaatgtctatatattttttattagatggaattaatctatatacttttggtaagttatataaaaaagattatagttataagcaagggtttgtaaattcgatttcaggaactttttttaatggggttacccccttttctagtgggggtcaatttgcacaagtctatatttttaataagcagggaattgccccaactaactctgctagtattttattgatggcttttattgtttaccagtcagtactagttttatttactgcagtagtgatgattttccgttatcaggcttatagttcaatgtattcagaatttttttcattagcaattttaggcttcttgattaatttctttgttattactggactatttttaggtgctaaatcaaagcgattacaagattttatttgtaataatattgtaaaagcgttaagtaaaataagaattgtaaaaaactatgaagatacttctattaagattgcacgttcacttgaaaactttagaacagagttaaacgtgttattaaaaaataagaatgtattgataaaatcatcattaattaatttgtttaaattattaattatgtatagtattcccttctttgcagcaaaagcattaaaccttaatgtttcatttatccaaatattcgattttattggtatttgttcatttgtttatatgattactgcctttgttccgattcctggagcaagtggcgggagcgaaggagtttattatatgttatttagccctattttaggggctgttggtacgccaacaacattattagtatggcgctttgtaacctactatttaggactaattattggtggtatcatttttgcaactaatcgagaaataaatagatcggagtaaagtaatgagaatagcaattttttcagatacatatatccctgatattaatggggtagcgacatcaactaaaatattgaaagatgaattagtaaaacatggacatgatgtagttgttgttactagcgagttacctagtgatagtgattatatggatgatcctcatgataatatcttaagagttcctggattggaaatacaagccctgtatggttaccgggcttgtaatatttattccttcaaaggaatgcgtgaaattaagggaatgaacattgaagttatccacgttcaaactgaatttggggtaggaatatttggaagaatcgtaggagaaactcttaatattcctgttgtctatacgtatcatacgatgtgggcagattattctcattatgttaatcctgtaaattctggagctattgatggtttgatcaaaaaggcaattacacgtattagtaaattttatggtgataaaagtactgaattaatcgtaccttctttaaagactaaagaagcattagaattatatggtttaaataaagacgtccatattattcctacaggattagaactagaaaaatttgatcctaaaaataaaaatactgaattgattgagcaaattaaagacaaatatggaattaaagatcagtttattgtaacttttttaggacgaattgcgaaagaaaaaagtattgaagtattaattgatgcaatgaaggaagttattaaagaaaatgataatgtactttgcttgattgtcggtggaggaccacagttagaggaattgaaagaattagtaaaagatgatcatatcagcaattatgtgatttttaccggtcctaagcctagtaatgaggtaccaagttattatcatttatcaaatgtatttgtttctgcttcaataactgaaactcaaggattgacttatattgaggcgatggcaagtggaatacctgctgttgcacgctatgataaaaatttggaggatgttatcgatgacggtgtaaatgggtacttttttaaagaaacatcggaactagtggaaatcctactaaaattaattaatcatgattattctaaaatggcagaagccgcatacttaagtgcaatgaagtttagtagtgaagtattttatgaaaaggtaattgctgtttatcagcaagcaattaattcgaaacactattcatatacggtcaagtcgatatatccggttaaaagagggataaatgaagttgtttttctatttgatgaaagtgagattattgttgaggtaaatgataaattaattaaagcttatcaattagagccaaataaagttattgataaagagttatttgatgttttaaaagattttgaacaagtttctcgggcctataataaagcgttaaaattactcacagtaaaagattatacttataatcaaatgaaaaagaagttaatggatagtggtgattatgatgatacacagttagatgcaacgctagagttacttcaagagaagaatttaataaatgatgaagcatataccttaaattatttaaaacgctgtacacgacttggaattggcttaaataaagctatttataatttacggagttatggaattgatagtcaaattattgatcgatgtttagaagagattgatgatgatgacgatgagtataatgctgccaccacattaattgaatccatttatagtcgtaatactagtttttcttataaagcaatggtgaagaaaattcgagataaactttatataaaaggctttacttctgaaacaattgaacgagcacttagtgattttgattttgagtttgatgatcaacaagaacaagaagctttggaaaaagaattctcaagacaaaagaaaaagtattcaaaaagatatcaaggtactcatttaaaagaaaaaatcattgatactcttttaagaaaaggttacaattatgagcatattaaagaattattaaatagagaaggagccttggatgatgaataaaataaatgaattaaaacctggtgatgaaggcgtagtaattgaggcactgattaaccgtgttgttgttggaaaaacaaatggggccaatcgttctacctatcttagtattactttacaagatgctactgggacaatcgatgctaaattgtggaatgcaactaatgagcaagtagaaaagttagttatgggttgtgttgtacaagtaaaaggtgatgtaatcaaatataatgaagatcgccaaatgaagataatcaaaattgttgttgcttcaactgaacctcaagaacaagttaaatttctaaaaagtgcgccacaaacaggagaagaacttgtaaaggagatttatacttttattgagcgaattaacaatcttaagttaaatcagttagttaaagcattattcaacgaacatgttgaaaaattaacaatttatcctgctgctagtaaaaatcatcatgagtatgtatctggattagcatatcatacttgcagcatgttaaggatagctgatgctttggctcgattatatccatcattaaatagagatttgttatttgcgggaattacattacatgatttaggtaaaacagtagaactaagtggtccagttgtacctgaatatacaatcgagggtaaattattgggtcatatatcaatctctcaggcaatgatcaaagaaatggctgataaaatgaatattgagggtgaagaagttacgctgttacaacatataattttatctcatcatggaaaaaacgaatttggttcaccaatactgccacaaatcaaagaagcagaggtaatttatttaattgataatatggatgctcggatcaatatgctagataaagctttagagacagtagaaccaggtggtttttcaaaacgagtttttgctttagaaaatagagccttttataaaccaaaaatgaattaaattaagattgtaaaacttattaaaaagagtaattctatcatttgacagaattactctttttctgtgtgccgagcatggcatacatttagctggtgaaagtcccaccacgggtatttaccgctaagagtagtgaaccacaaaccattagtagtgatgctatgggtgatggaattggtgtagcgaaatattcgagattacgaaaagaaattttatgaggctgaatgggagataaggttgcagaacaaaccaagacagtaaatcaaaaacctgtgaagataaaaaaagatgtatgccttacctcgggagaccttgtggacgatgaagtccagtaaactgttaaaaacagtaatgataccatcgatagaaaaagatttatcacaagaagtctgatgaagtcatagtagtcagaaatgatgaaggactgaaacgtttatagagtgcaaatcactataagcaatatttggatagttcgaaagtgagggtagcctagaactgggaaacgtaatcctagatggtaaaagtaaagagaatttgaaaatgactatcgaaaaggtcaaacaaaataaaggagtacctggaatagacaaaatgactgtgcaagaggtggaagaagccaaaggcaatatatagaaatctaatgaaattaaacaaggcatgtaaatgtagatttagtgaagatgacatttataagtgtgcaaacacaaggttaggctggtataggagaagtggaatgaatatagtcaattttataatatcgctaaaagttctaagcataaagaaaggtgatagaccaggtttagtctatcacctagattattatcttaagagtgatataaatgtagagccgtatacgagacacgtacgtacggttcaatgggagaataaattatcaaatttattcctttaccctattaatgaaatagaagtataaataacaatttaattatttaaatttaagaatttttacgatcactttaaaaccaattagcagtttcagaagtatgataatgtatttgcaattcggaaatgtgataacttaacacattattattaaaaagtggttcatgtttataaaattcttgtatttcagtttcatttctagattttattacagttattgaagaactcatatcgctttttaatgacgaaaagagtactttccccgctttcattaaaagatttgtatatttttgatgctcttgcatcatttcatttgtcattcgttcaggatgagtaacgataccttcgattaaaaaatacttcatagttttaacttcctccaaagtcaataattttaaataaattataacatttagattaagtatcgtcatttttttaacttttataattacagataggataatcaatttaaaatgattttgataaaaaaacgctaaataagtaatatacaagagtaaattactttaatttagcgaaaatatctaagttttataagctgtttattttattaaaaatattatctaaatcaacttcttgactacgatcagtaaagtcgattttgatttgatctgtttcattatatcttggaataatatggatatgaaaatgcataacagtttgaccagccacttcatttgcattggtaagcacatttgcgccttttgcgtctaaattagtgattatttggttagtaagcttttttgttactttgattagatggctcaaaacttctttatcaacatctaaaatattttgatagtgtgttttaggaacaactaatgtatgtccgttagttgtttgactcaaatctaaaaaagctagacataaatcatcttcatatacaattttaccaggtatttctttattagcgattttacaaaagatacaattctccatttctataagtcctccataatattattctaacatagaaaaaagataaggggaaaccccttatccgaaataatcttcatttgattctttaatttcatctttgattgctgattcgtatacatcaaaattgtatttctttaaataatatgtttccatttttgtagacatatcactaacagaagctaaattagtaataatttcatcttttagatcttttttatctgtattgtaaacataaactacagcatatttagattcagatgtcttaatcactttattataaataccatctttagtaaatttatctaattttttaataatttttgagtcgacactgcttgttttagtagtgaccataccagcatcagtaccattgttttcagtcattaaagtgtcaaaatcactgccatctttaactttatcaattaaacttaaggcagctgattcagtgtctaaagtaataatttttaaatatttaactttgtattctttaaccaggtcatcatagttatctttaatatatttttctttaagcatggtttgttttactcctaaagttaaaacaccatcgatatattcttgttcagtttcataaccatattgtttagcatattcttctaatgaagtagttaagttttcagtaaaacttgcaaccttttcattaattctagtttgcactgcatccttatctgtcagttcttgatcagcaatataagttaaagctaatgaaagaacttcagaacttccatattcttttagtaaataatggtaaacatcatttttactaattttaacatcatcagcagttgcaatagtcttatctccatcttttatttctgaagtataagtagttgcactagaagaactacatccgaccaaaagagttgcaactattgctaaaggaaatatttttttcttcattagtttgttcctcctcggctagtttcgcgttcttttaaagcttcatcaattacattattaattattttttcagtatttttatcatcgtatttaacattataagattgataaacaatatagctcatatacttatcatatgcaatcaatggagtatcaatagataaatctttttttatttctttttttatactatctttatcagtactagtaacttttacaaaataatatccatcagtaccttttatggcttcactagtttcaccactggcaagtgctaatattttagtttcaacatcactaccaaatgtttgtgaaagaccacttgtagtatctacaatacctaattttcctttattcttgttagtgtttgtatcatcagagtaatctttggcgatatctccaaaacttttacttgagcttaataaagcagtgacttcactcaattttgctgtttcatcagctgttggattttcaacatcagtcattgaaactttaataagactagcttcacgtggacttgcttgagtgtaataatcatcgaaaacttcatcaaagttcttttcaacgtaagctaataaaaagttgcatctttgatagactctcaccatgttttcacgatattcatcaagtgaattaaatccacttgaacttaacgctgtttgtaattgagtttcagcattatcgccatattgattttcatagtaagtttggatttgatcaactgtttcattagcatcagtttccatatcctcatcgattgggaatttttgatccattaattgttgaagcacggcattaaagtatgaactttttccactggcagtagatattacatcgttaaaaatatcatccgcaaaaatatttttatcttttttcccactgtttaaagaagcaactacatatttcccatcttctttaactgttttcgagctgttttgacaaccagttaataagaaactagtcacgactagtgccgcagcacatttacctaatttcatatctttcctccttatctttccataacgttacaattatactatttatcgcatctaatttcaataaattaggcaaaaacacattgccaattgttattttaacataatttataatatgtaggtggtaggaggggatttgatgaataactgtaaatgcactaatgtaaacatctatgtcttgtttattattctagttattgtaggtatctattgtatgtaataaaaaggaggcgattacaatggcatgccaagataattcttttacattgatcttagttttattcattttattagtaatcatttgtaatatgtgctaattaaaaaaggatgtcgtcaagacatccttttaaatataaaaaactattgcaataaaatgtaagatagaagctattgaaataaatatatgccagattacatggttgtagggtatttttttatttgcataaaagtatgctccgattgaatacattaaaccaccgataacaattagccagagaaaagcagcactagaattttgaatgattgaaggcataaataggatggctgtccatcccataactagatagatagttagcgaaagctttggtaaactttttattgaaatagatttatataaaattcctactattaccattgcccattgaataacaaggatgatgattccctgatatcctttaattaaacacagagcaactggggtataacttccagcgattgcaaaatatataaagatatgatcaaggattctgaatacctgtttatgaggactgtcatgatccatagcatgatatagagttgaaacaagaaacattaaaaaaatgcaaattgtaaaaacactaactccaaaagattggataggaccacctttaacatatgcatatacagcacaagctgggattagaagtaacatgataaatgccataattccatgagttatacaattaaataactcttctttaaaatatggcggaaagattctttttattttttttgtaattttattattcactttttccaattttatcacccagtacatactataatataaattacttttaaattcaaacaaaaatgatacgctgctgcgtatcattccataagcttttcattttgatgattttctttataaacttgaaaagttattttagcacttactaatagtggcatagcaattaccattccccaaataccgaagagagaagaaccagagagaatcccaaaaagtacccacattatactcaaatcaattctagatgaatagatacgtggagtaatcacatatgacataatcgtcgattgaatgaaaatcaaaataaataaaataacaattgtagtagttcccattcctaacgaagtaattattcctaaacaattcgcaacgattgggccaacatatggaataatggagctggctcctgaaacaaacccaagaattaaccagttaggatgaccaattgctagatacatcagcattgttgtaattgcttgagcgattgctccaataaagaaagctttaacatattgtactaaagaagaatcaatttcacgtaaatagattggcaatgttttatcaatacgatatgtaatattacgaatatgactacggatatttttaaaattactagacatataaattgctagaatgatgtagattaaaaaattagtgacattgatcataacttgatttaaaacatctatagttgtatctaaaacaactgaatctttaaagaaagcattgacaatattctgaatatggcgcattaaagaagaaatatcataattgaaattttccttaacaaacacaccaatttcaccaagtcctgagtaaaaagccgggaacatttcagagatactttcataaatcattggtacagctaaagaaattaataaagttaaaatagcaaaagcagctaagtagaccattgttacggcaatgcttcgtttagtaacatacttttcaatataatttatcagtggatttaaaacaaaggcaattgtaaatccgacaataaatggtttagaaaccagccagatcgctgataacaccccataccataaatcaccagtggcaataattaatagtaatattactaaaacgatcatcacatttaataaagtatgggtgattttttttgatgaaataattttaaataatgcttttagaaattccatttttacacccccattacatataaatataccacaatttactaataatataaattgaattgaatttctattttagaaaaatcaaaaatagttaaaatgtataaagttttataattttcatctaaaaaaagcaattggatgttatgattagaatattataatagagcaaatctcttgataattatcgataatttggtcacaatgtggttataatataaattgtgctagattttgattggaaaatagtaaaaatttttgctataatttatcattttatttgttttttgataacttatctagtagaattagtaaggatagaaaggggcttaattatgtcaactttaaaaatagaaaatttgcatgtcagtattggagaaaaagaaatcttaaaaggtatcgatcttgttgttaatactggtgaaacccatgcgattatggggccaaatggtaatggaaaatcaacattattatcagttatcatggggcatcctaaatatatagttactcaaggtagtatctacatagatgatcaaaatgttttagaaatgagtgttgatgaaagaagtagggcaggaatctttttaggaatgcagtatcctcaagaaattccgggtgttacaacttcagattttttaagagctgcattaaatgcacatcaagaaaaaccagtatctttatttaaatttgtaaaagcactggataaaaatattgctgatttgaaaatggatgagaatttagcacatcgttatctaaatgaaggcttctctggtggagaaaagaaacgtaatgagattctacaaatgaaattattacaacctaagtttgctctattagatgaaattgattcaggtttggacgttgatgcgttaaaaatagtatcacaagcaattaacgctatgaaatcagatgattttggatgtattatggtttctcactatgaacggttgtttgaattggtgccaccaagtcacgttcatgtattagttaatggtaaaattattttaagtggtggaattgaagtagtagaaaaaattgatcaagaaggctatgactgggtaaaagaattaggagttgaaatcgctactgatgaaaagaaaccgattttacttgaaagttgtgccaataaagaaagaatgaaagctaaataatgaaacaattaaaagagattaaaaattatttagtatttcataatggtacaattgaatgtcacccagaaaatgtaggaattgctattaatgatggtaaaatcgatgttaaagatgctgcctcattacaaattatttatctaattgatcaagaaggaaaatattgttttgacctaaagattaaaggacaactggaattaattgagacttatgattttaaagttccagcatctttagttaaaaacattgaagtattgcaaaatagtaatattttaagatataacgataatcaaagcagtgtcaacgggactgttgaagtaactgaaaatgtatcggttgagcgtgatagtaatgtaagatgcgcttatgttgagttatcagattcaagtattgaaatgaatgttaatcatgctttgaatggttctaacgctaatagtacggtgcgcttagcttcattagctaaaggacaggaaaagaagcatatgacattttcgttaacgcattttgcaccacatacaaccgggattatggataattatggtgttgttaaggatgcatctaatttagttatcgatgggattggaacaattaaacaaggaaatcatcaatctagcagtcatcaaacaaataaaattattgtttttgatgagaaatgtaatgccaaggcaaatccatatttatatattgatgaatatgatgtaaaagcaagtcatggtgctagtgtcggtaagattgatgaggatcatttgtattatctccaatctcgtggtttaagtaaaaaagatgcaatgcatttagtaacttatggatattttattccagtcatggaatttatagataatgctgatttaagagagatgtttaacgaaacattaaaagaaaaggtgggaatttaatgttagatgtagaaaaaattcgtcaggattttcccatgttaaatggtgctacgatgcatggtcaaccactgatttattttgataatggcgctacaactttaaagcctcagtgtgtaattgatgctgtatgtaattatttgacaaactattcgggtaatgcacatcgtggtgactatgacttatcgcatgatgttgatacacagttcgaaaagacacgtgatttagttgcaaaattaataaattgcgatcgaaaagaagtagtttatacatatggttcaacagacgggctaaatatgatagcatttggctatgggatgacgcatctagatgaaggtgatgaaatacttttaaccgttgctgagcatgcctcaaatactttaccatggtttgaagtctgtgatacagtgggaagtacggttaaatatattgatttagatgatgaaggacgtcttactgttgctaatgttttaaaagcaattagtgataaaacaaaaattatttcaatagctcaagtttcaaatgttcttggatttgatggaccaattaaagaaatttgtcaaattgctcatgagcgcggtattatcgtttgtgttgatggtgcgcaaagtattcctcatgaaaaggttgacgtccaaacattagatattgattttctagttttttctggacataaaatgtgcggaccaactggggtgggaattctttatggtaaatatgatttattacaagaaacaaaaccaactcgttggggtggtggaagcaatgcccgatataagagctgtggaaggattaaattaaaaaatgcaccggctaagtttgaggctggaacacctaatattgagggtgtcattggtttaggtgccgcaattgaatatttaatagaaattgggatggacaatattcgtgattatgaattagaattacgtcaatatgcggttaaaaaaatgttagaattagataatttggaagtttataatccaaatggtcatggagcgattgcttttaatatcaaaggtgtttttagtcaggacggagcttcactatttaacacatatggtattgcaataagagctgggcaacattgtgctaagattcttgatgaatttttagatgttagtcaaactcttagagcatcattctatttctataatacatttgaagaaattgacagatttattgaggtatgtaagaaaggagatgactttttagatgccttctttggatagtatgatgttacgacaaataattatggatcactatgaaaatccacgtaatcatggactagtagatgatgataattatcagtcagtaaatatggattcagaaacttgtattgacgatattgatgtgcaagccttaattgaagatggtgttattaaagatatccgttttgatggcgaagcatgtgcaatttgtactgctagtacgtcaattatgagtgaattattgattggtaaaacaattgatgaagctaatgttattattgaaaattacaataatatgatttatgaaaaggattatgaccctgaaattttggaagaagcaattgcgtttatgaatactcataaacaggctaatcgtattaagtgtgctactttaggatggacaggaatcaaacagatcctcgataaagaataggaggaaacatatggcagatataaaaaatgaaattcctgatcaggaatatgcctatggttttaatgatggtgatgtttcagttttcaagactcctaaaggaataaatgaagaaattgttactgaaatatcaaaaattaagaatgaaccagaatggatgcttgaatatcgtctaaaatcttatcgctgctttatggaaaagcctatgccaacttggggcgttaatttagaccgtattgattttgatgaatatacttattacgttcgtcctagtgataaacaaacgaataaatgggaagaagtacctgaaacaattaaacaaacatttaataaattaggtattcctgaagcagaacaaaagtatttatcgggagttagtactcagtatgaatcagaagttgtttatcataacatgttaaaggaagttactgaaaaaggtgttattttcctagatatcgatagtggtttacgtgagtacccggaaatatttagaaaatattttgatactgttattccttataatgacaataaattttcagctttaaatggagctgtttggtctgggggatctttcatttatgtaccgccaggagtgaaattagataagccactacaatcttatttcagaatcaattctgagcaaatggcacaatttgaaagaactttaatcattgttgataaaggagcggatatccactatgttgaagggtgtactgcaccaagttattctcgtgattctcttcatgctggagttgttgaaattattgtgggtgaaggagcaaaatgccgttatacaacgattcaaaactggtctaacaacattttgaatttagtaactcagcgagcaaaagtatttaaaaatgggtcaatggaatgggtcgatggaaatattggtagtgctgtaactatgaagtatccaacttgtgtgttgatggaagagggagcaaaaggttcttgcattactattgctgtagctggtgagaatcagattatggattcaggttcaaagatgattcacttagcgcctaatacatcaagtagtattgtttctaaatcagtttctcgccgcggtggaaaagtcaattaccggggaatggtacagcatggtgctaaagcttataattcaaaaagcaaggttgaatgtgatacgttgattttagatgacatttcaactagtgatacagttccggttaattggatgcgaaataatgattctattattgagcatgaggcgactgtctcaaaaatttctgaagaacagcttttctatttaatgtctcgtggtttaacaaaaaaagaagcaatggaaatgattgtaatggggttcattgagccgtttgctcgcgaattaccaatggaatatgctgttgaactaaatcaattaattaaattggattttggggatcagggtattggataaaaaagtattacggaaacaattgattcaagcaagattagatttagatagcgaaacttatgcatctaaatctaattttattgtttctaaattaaaacagcaacctgaatttattgaggcaagagcaattggaatctatgtttcttttagacatgaagtagaaacaatcagtttgattaaggaaataattaataataaaattgtctgtgttccaaaaattagtggtaaacagatggatttttatcaaattaattcaatcaatgaattaaagacaagtaattttggaattttagaacctaataatagtcatcctgttactaaagataatcttgatttactaattgtaccaatggttggctacgatcaaagtggtaatcgattaggttatggcggtggttattatgaccgctatttaagtgattattgtggtaatgtaattggcttggcatttagtttccaagaagttgcaaatttaccagtagaaccatttgatttgccgattaaaaagattattaatgaaaaataatcacggttttgttataatggggaatataaagtagggtgaaattatgtcaagagagaaaacattagttaaaaatacgttaattatggcgttggggacttttctgcctcggattattaatttattgactacgccaattattactagtgcaactactgatgcgcagtatgggcaattagatttagttacaacgacgattctttcatttattgtacctttatgtacgttgcaaattgaacaggctctatttagatttcttgttgatgctaaaagtgaaaaagaacaacggcgtgtcattactaacggatatgtaatgatttttggacttatggtgattgctgcgattatttgtctgtttgtgccaatcagcatgtttgaaggcagttttaagctattgattattggatatatatggattgagattattgcaacaacttctaggtttgttttaagggctttttccaaatataaagagtactctattttggcggcgttagttgtaatagtcaactttgttgttgtctcagtttgtttattgtggctaaagacagggtatattggggttttaatagcattagtagctgctgatgtagtcggctttatttatgtactatgcgtatgtaatatttttaaattttttaattttaaatattttagtagcgaatatgctcttaaaatgcttggctatgcattaccgtttgtacctaatatggtatcatggtatattaatcaattgtctgatcgatggattatttcaatttttctaggggcagggccaaatggtgtttatgccttggctaataaaataccttcgattgttaatatcttatatccggcctttaatttagcttggacagattcggcaacaaggagtgtaaatgatcctgatagtggcaggtattataataggatgtttcggatgttgttttgcattgtctcagcaggttcagttttattagtggctggatcaccgatcatctttggaattttatgccgtaataaagaattatatagtgctttcgattataccccaaccttaattttagctacatatttttattgcttctcacaattttttggaagtatttatgtagctgttaaaagtgctaaaaatatgtcggtaacaacgactattgcagctataatcaatattatcatcaatttaggtttgattaatattattggagtacaggcagctgttctttcaacattggctgcgaatttatttttagcgggatatcgcttctttgatttgaatcggcgctatgtacgtttaaaaataaataaacgtctaacagtgttgacaatcgtaatttttataattagtatgtctttagcatggtcgggagataaaattttatggatattaaatattgttattgcgcttggctacgcatactttatttctggtgatatttttattggaatgtttaaagctgttttaaagaaacgttaatagtaataatgttaagatttaattatttagtaaagtaattaaattttaacattttttttatgtccttttttgtatagttaatattaatgaattgggttacaggaggatactatggaagcatatcaaaaatcgtttaaagaggtccagcaagcactaggagtcagtgataatggattaagtcaaaaagatgtaattaagcgtcaaacacgatatggaagaaatgaaattattggtgaaaagcgtcaaagtgtttggggaatcttatttgatcagtttaaagatttattagtaataattttgatttgtgcgggtattatttcagctattagcggagaatttgaaagtacattggtcatcttggttgtaattactttaaatgcattgctaggaacatttcaaactgtaaaagcacagaaatctttggatagtttaaaaaaattatctatgccaaaaataaaggtgttgcgtgaaggtaaattagttgaaattaaatcaaacgaattgacagtaggtgatttggtatttatccaggctggagatgtaattgctggtgatggacgcttaaaagaagcgaataatcttcaagttaatgaaagtgcattgacaggtgagtcaaatagtgtcgaaaagcagttagttgcaataaatcatcaatgtactattggagatatgacaaatatggttttttcaggaagcttagttacaaatggaacagggcaatatattgttacaaacattggaatgaaaacgcagttaggaaagattgctgagatgttgaatgcaactaaacagcgtcgtacgccattacaaaagacgttagatgaattttcagtaaaattgtcaattggcattatttcaatctgtattattgttttgtttatggatgtctttatcgcaaaagaacaattgctcgatgctttgatgattgcagtagcattagctgttgcagcgattcctgaggcattaggatcaattgtgactattgttttgtcgatttcaactcaaaaaatggctaaagaaaatgcaattattaaaaatttaaatgctgtggaaagccttggttgtgtttcagtgatatgttcagataaaacaggaacattaacccaaaataaaatgacagcagtcgatatatatacaaatcggatgttaatacaagcaaatcatttaaatcatcatgaatattgtcataatatcttattaaaggcttttgttctatgtaataatgctactatttctaaagcacagagtattggtgatccaacagagattgccttactggaattatatcaagattataattataaaaacgcatatcgattgcagactaaacgtcaacaggaattgccgtttgattccacccgaaagctgatgagtgttacttcaaagaatcatctatacactaaaggagccccagatgttttattaaaacgatgtaatcgaatattaatagatggatataaagaaatttttactaataaagataagcagcgtattatggaacaaaatgatgctttggcgcgccagggaaagcgtgtattaggatttgcgtataaagagttttatcgtaatacattagaaaaaagggatgaaaatgatttagtttttgttggtctagtatctttaattgatcctcctcgcattgaaagcgctcaggcggtcaaagattgcattttagcagggattaaaccaatcatgataactggtgaccatgttgtaactgcgtgcagtattgcaaagaaaattggtatttttaagcaaggtgataaatgtttagagggaactcagttagataaacttactgatcagcaattgcggaattacttgccacatgtatctgtttatgcgcgagttgcaccagaacataaaattagaattgttcaagcttggcaagcacgtggagcaattgttgcaatgaccggtgatggtgttaatgatgctccggctttgaaacaaagtgatattggggtagcgatgggaattacggggagtgaagtttctaaggatgcagctagtatgattctgacagatgataactttgcaactatcgttaaagcaatcattactggccgaaatgtatatacaaatattaaaaattcaattatctatcttttatctgggaatttatccgcaataatttgtgttttagttacatcatttgcaattttaccaactccttttttgccggttcatttactatttattaacttaattacagactctttaccggccattgcgattgggatggaaaaggggagtgatgaaattctaaagcaaaagccacggggatcgggcgattcattacttaataaagagacaattttacaagtgagttttgaagggataataatttgtattttcacaatgttagcttattttattggtttacgcagtgatgaattgactgcttcatcaatggcatttggaacactttgtttggcgcgactattgcatggatttaactgtcgaagtaacttgccactatataaaattcctgtaaattattatagtgttggagcttttgtaattggagtatcattattaacatggattctaatttctcctaattttcattcacttttttcaattagtgaactatcactaaaacaattagcaataatttttgtttctgcagcatttccaagtattattatccaaatatataagatggtttcttcgaggtataattagaaacaaaactaaatataatatattggtggtttaatgaaaaaacgatatatatttattgtaattaccattattttagcaattgttattcaagttcttagtgttaatattactcctgcattaaagaagattgcagacaaagaaataaatcggttttgtcagatggtaatcaacaataccccttttccagttacattagaccatcaggaactgatcaagatcaatcgtaatggtgatgaaattgcgacaattaattttaatacgagttatgcttcaagtattggagctaaaatggttaataaattagatgaattgtttgtagcgattgaagaaggaacatataaaaaaacagataattctttttatcaacgtcgatttcaaaagatgagtgacgaaggtggggtaatcgcttctattcccattggagcattaacacaaaatcctttcttagcaggtgttggacctaaaataaaacttaaatatgaaactatatctgcgattacttgctcagtcgaaaaagatgttaaaagctacggtgtgaatcatgttatggtttctttgaaattggttattaaaattaagatgatggtattattaccattttataacgaggagtttaataaagactatgactatccattagtgatggaaattattgaaggggaggtgcctaattggtatcagaattagaaattttacaacgtttttatcagatctatctagaacaagaaagtgatttctttagttttcaaggtaatttttattatttatgcaaggttaataattttactagtgactatccatactatgtaaatgcattaggactaaatggtttcatggttgttaataactgttttaatcgtcctatctcaatggactatatattgtatacttatcaaatcgaagattatcattttgaaatgtttttacaatattctttgcgacctttagatattcaggttgaagttttaaaaattaaagaaagctggtgtgcaattcttgatgaagcaaagtgcaagattggtaactatgcttcaagaatcagtcattttgaacattttgtagtgctgtcatattactatcaaggtcttggagaagccgcaattagcgtgttaaatgaaattagagaaactaagctagtagcggggatagaacactttaatatgatcgataactatgagatgctttgctgtccagctaatttagtcatagcttcaagagtcaaggatttagccagtagctataaaaataatttgatttcagttgaacagttagaacagtacattcagattagcgctctaacagtagatgaaataatttatctctattcacgattattgtttccaagtgaatttatgcagctggcaatcaatgatgattgtaatgatgcacaaataaaaaaaacacttttgaatatgtatcaaaatatagataatcaaaaagcgtctttagtaattgcgtggcaaatgttaaataaatatactcgtttacccaaaattgcctggttataaaagccaggtaatttttaataaaataaaaaacccacacttagtgtgagcaatttactaatggagcgggtgatgggaatcgaacccacgtagtcagcttggaaggctgaagttctaccattgaactacacccgcaattttaatgcattaatatgatagcactatttttaaatggtgacccgcaggcgattcgaacgcctgaccctctgattaaaagtcagatgctctaccagctgagctagctgggtaccataaatcaggtacccttttagttggaatgatatactgttattatcagacgaatccaaattcctatagaataaaaaatggatgtaccgtgtatttatacacagtacatcctccaaaatacctctgtcaactctcgaagcagcatcatcatccctgttcgatctgcaacattatagccattcaatttttgttcatcaccccaataatataatggaatatgtgctaaaccagccaatcgattttcattaaaatgggtaaccgaaataacaaaaattccattctgttttgcttcttctacccaattattcaaacgaccattctcaccacttgcactaattacaaacaaaatatctttttcttcacaatgcttgattcgatattcaatttcacgataagtttgataatattcagctcgataatcataacatcgcaaattatcgaccatcatttcacaaaaatataatgactcaccgacaccaataaagtgacatgttcgggcattcttgatcttagcggcaacttcttctaacgttttataattaattagttccattgatttatacaaattctttgataataatttttgaatatctaaattttctgatacttcgttattaactaaaaatttcatctctgcaaagcctttataccctaactttttacaaagacgcatgattgagttgggaacaagataaagatcttcggctaccttttgaattgataaatgttccaaatttgctttatttttacgaatataatcaacaattagatcatctgtatcgtttagtgtaaactcttgttgtaagacccgttcttcaaatttcattatattatcctccatgacaagataaatatcaactctctcaatataacttatattctaacattattttttgatttcggtgcataatctttcaattctggaattgctcccgcagcaactgcccataaatacaaactggcaattgttgcatatggtccatagcgacgtttatatttagtgaatagttgaggtgtaattcgccgatgatgatagaccatgcgcattccccgtaaaattgctaaatcgctataactaattatatctttacgttgtaatgaaaatgttaaaatcatctctgctgtccatctcccgattccaggtaactcacaaagctgttctataacctcttcatttgatagatcagctaatcgctccaaatccaattgatcactaatgatccgtctcgttatttctttgatataatgtgcttttttcatcgtaatgccacatttttgtaattcctcagctgaaagtgatttaaaatttgctggggtaatcggactaaaagaattgttgattctctgccaaattgtttgatgggctttagtagaaatttgttgaccaacaatcgaattaactaaagctgcaaataaatcaggtattaccgcacgtttaattataccaatctgctcgattacttgttttaaaacaggatccctacttttcaaatattcaatttcaatatcgctatattcaaaatattccattatatactccaacctataatcttatcgcatagttacaataccatcattttaaaacaatcaaataacttttttgactatattgattagctttattaatttcaagtatacttgaagtactaaactttgtaaataaatgaaatattatataaatcaagtatgtttccttatgtaatcaaatagtttatattactgcttttatccttatgattataaattgttagttcataattatctaataaagcacaacgataaaaatactctagtaagtttttactagagtatttcatttatactttaaataactcaataatgtcattagtagacattgttgttatactaccttcattattttccacaaaactatcagctaagtttttctttttattttgcagttctaagatcttttcttcaacactatccttcattaccaatttataaaccgttacaacattttcttgcccgattcgataagcacgatcagtcgcctgattttgtgctgacatattccaccaaggatcaaaatgaataactgcttcagcagcagtcaaattcaatcctgttcccccagcttttaatgaaatcaaaaatactgttgtatcatcattttgaaattgattaactaatcgatgacgttcttctttttttgtatcacctgttaattgataataagtaatactttctttctccaattctttagcaattaaatcaagcacggaagtaaaagaagaaaataatagcactttttgattatttcccaggaaatttcggattaaatcaagacatcccgataattttgatgaaatattcgaaatattatcatatattatccgtggttcacaacaaatttgtcttaatcttgtcaacattgctaaaatagcaatacgatctacattatcataattaagctgttcttgcagttctttattgacctgaattaaattagctaaatacaacttattttcttcttcattaaattcaattgataatgttttttcaatcttctccggtaattcagtcaatacatcttttttattacgtcttaagataaatggtgtaattaatttttttagttcctgctgtttgttttcatcatgatttttaacaatcggtgtttcataattagttttgaaataatggtagctatacaaatactctggcattaaaaaatcaaaaattgaccataactccgccaaagaattttctataggagttccggttaaagcaaaacgatgtttagcttttaacgattttactgttatcgcattcttagttttaggatttttaatatattgcgcttcatccaaaataatattttcaaattgataaccatcataaagattagcatcacgacgcatataatcataagtagtaattagcacatcaacctcattaaattttctaattgcttcttttcgtcgttttagactgccgtgaatacaagtacaagataaagaattagaaaatttatgtatctcatcttgccaattcaatagcaatgatgatggacaaacaactaaactagtttttttatcatcccgattttgatccagtaaaacaatcatttgtaaggttttcccaagccccatatcatcggccaaaattcctccaaagccataagaactaattgattgaagccattgatatccaaatttctgataatcgcgtaaaatttcttgataattaggcgctaagggataactctgtttagctatatttttaaaattatcaataatttctttaaatacggtactacgatcatatactaaataattgcttgtttcggctttattatcaagactaaaagcccgatagacatccatttctaaatgtccatcctcaagcatctttggtctaatttgataatcagtcataaattcatttaattctttcagctcatcagaatcaagatataatagttgaccattttttaaccgatgaaatttcttcttcttttgatatgagtttaagactaacgctaattcatctttaggaatatcaatactttcaatgtcaattgccaataagtcattttctaaagtcactcctacagtaatactaaattgacttttcttcccaatctttttaagtgcatcactaaccatcacttcacaataattagctaaaaaaggcaaaccttcatttaaaaaggagtaagttttttcactttctaaattcaaatacatacaatgtttttcaaaatcaactacatcaccaatctcttttaaataatcttcaattaaatcaaaattaattgatgtttgctttctcggctgttgaaatgaataaatcgtttctaggccttgtttactttcaagataaactttgatttgttccaattcattaatatcgccatagagtgtcaatatttctgtttcgataacttcacttgttaataagtccccagtataattaaaatattgcttaatatcatttaaaatatatttaacaaagtcatttacatcttcttttgctaataataatttgtctttactttcgcaattatgaataaatttgattgcttttccttcatcatccagcttaaccatacctatttcattttcagtaatcttataaagatttttataaccacaaaattcatcaaaatcctttaattcaagcgaataatatttttcaagtttccttatatgtaaagtaggctgataattgtattgataaattgataaatgttgattagttttttctaaatcttttaatacttcatagatatattcaatactttcgggaataatctttatctcatttgtcacatgcgatatatcgtaataatattcctgttgataccgctcataagtgatcatacaaaatttcattaattcaataatcttcagtgcttcatcactaaatactttttgattatgaacaaacgctaattgtttaccatattcaacatattcattatttgctaatgcacttaaaaaattaggaatattttttattatatactttttatcacttcctactttgaattttaaacatgggtgcccataattaatcttgatctggacttcaagatcatacttttgatttagtttaacctgattaaaatcaattgctttagcagtcttaaatgatgctattaggttttttgttactgctaattcattttttagcagttcttcttcctgctgctgacgaatttgtactaacttgtcgaaataacttatcttaccatttttacttttatatttaaatggaaaatcatcaggtgataactcttgaaccttcagcaaaacagccccaatatgaccgcaagccgagagttcatcacaccaataacaattacaactatagtcagtaatcttattatcttgatcaataacgattttacacacattttcataactaccattatcaacaatgccttcaattgtataatcatcaaaaagtcgatcataagtaattgtgatttctctaacataatctttttgataatatattcgtcctgttcttagatttctaacactgcttacgattctatgtaattctttgtcagttacaagcacttaccagtcacctcctaattttctttaaaattatagcatatatcgaataatattcattagtattatgactaaactaaatacatagagttataaagatgtaatcttgcagcaagtatttatttcaataaatttcttattactgccataatcaaatttttaaataattaaatactcatttccacaagcattaataaacaataacaaatcatcataggtaattgatattgttgctgtattaatattagggtgaattaataatcgttgtgctcttaattcacgatcaatcaatatttttactcgcttattatcattaattattcctaatggtgtcactgatcctggaattaactttaacaattctacaagttcttcatcactagcaaagcttagccgcttactaccaatttgtttagctatatatttcaagtcagcacgcttttcaaccgtcatcatataaatgaagaattgtttatcactactttttaaaaatagatttttacatgctactccatcaatttgctcattaataaacattgcttcttcaacagtgctaactgattggtgattaattttttgataatcaatacccaactgtgttaaaaatttatatatatccattgttaactcctctttttatgataatgattttaacatattaaaagtttaattgaaaataataaaagcatccaaaggatgcttaatcaattttctttaattcataatcaaaaccatattttaaaatatattcttctagagtccaattattatcataaattattttagctgctttcttaccaacataacgtaaatgccatggctcattagcagttccagtaatatccgaacgatttttaggataacgaagaataaagccatatttataagcatttttagcaacccatttatactcatccgtatcaccaaaaaccattctctttttatcaattacactttggctagttaaatctactcctaaccctaattgatgttcacttgagccaggtttcgcaactaaaccactagcagtgacttcatcataacggttaaaataatcattataaatttctacttgttcatcatatgagcgatatccactatttaaaactaaatgataatcttcttttaaagcgtctttattcatatcttctaatgctttagctgcatcttttcgaagtttattatggttattatcaggagcaattggtatatcaggtacaacaagatcagcagggacataatctttaggtaacacaaaaccctttttaatcaacagaagtgtattactaggatctaaaacttcatattctgatccaacagcattattagcatcaataaatgggtaagtaaccgtaagtacagctgttattggctcttgattacttgcaagatacttaggcagatcctcaaagaccattccattaatctttaaataagatttaatttgcgaatatgtatatttattatcgacgattaccttaaaatcagacagctctgcaactttcattaaagataatacttgtttataactatattttaaatccttgagatcttgataataatcctgatagaaagtatcaatatattttattacttctttttttgaataatcttgatgttctttttgatatgtctgatactctaaataatgttttttatttttatattcattccaggaacttaaatcactgaccttttccgcatccaaataacgctcaatctcattatcatttagctgtaaaataatgctttgttcagaccaaccatagcccttcgtcattaaccgaattcttgtaaaattaaatgcaatcaatgtcccaagtattaacatagcgattaatacactaatgattactttataagggatttttttcttttcattgtacgacatgtaactgcttcttttcaacctattatcctcctcgatatattcttggcagtcgacttcctaaacgactcaaaatctcattactaattgtattagcttcaagtgcaatttcttctaccctaatttcttctgtaccatcttgaccaattacggtgactagatcattatcactgatatcactaatctcgctaacatctacaagcatttgatccatacaaattcttccaacgattggacacttttgacctttgatcaaaacatttccatttgaagaaagtatacgtggcaatccatcaccatagccaattggaataacggcaattacactatcacgattaaccttataagtcaagccataaccaagactcgcgcctttagtcaaataatgcagcattgcaatttgtgctttaattgttaaagctggttttaaatctaattgtacttttgaataatcattgaacgttgagtacactccatacattaaaatcccaacccgagcataatcggcattgatttcaggataatttactaatccataactactttgaagatgaacctttcctatatcataatgtcttaattttaattcattaattaaatcataaaaagcagctatttgtttttgggtgtattcttgatcaactttccttttactatcacaaacacaaagatgtgtaaaataaccctgaatatgaataaactggtaatcatatatttctttaatactctcataatcgcttaaatcaaaacctaaacgatgcattccagtatcaatcttaatatgaacattgatcatatgcccactttcatttaattgccgagcatgctcacgatttacaatggtttgaatcaaacgataattatgtaattcaattgcacgaatgggatgactataaccaagtactaaaatttcgccatatatcccatgttctcgaagtttgataccttcatcgatagtagcaactgcaaaagcttcaattcccattttttgacaatgtttcgcaacttctactaacccatgaccatatccttctgctttaacaactaccattaatgaactatttttatttaataatgaactcaattcatcaagattatgcgtgattgcatctagatcaacttcgatccaactgcgacttgtgcgaatattcaccatacttctcttttcctttcaataaaatctctgaaaataaaacagttattatcaatacactaataaactgaatcagcgggtcaacaactaaatgatcacacttcaataatttacctattccacgaacaacaacaatcatcaagggatgaaaaagataaatagctaacgatagatctttacatttagatattcgtttgcctgatattcgtaaaagtccctgatatagccaaaacattactaccggcaataagatattcattgaatcatgacgtacaaaaacataatctgctgcatcttgataacctttcaatagtgatatttctataaacatcaaacttattgctaatatcgtgctaataacgattactcttaaactaaagttaaattgctttaccgcaagaagttttccaatccaaatgaataacggtgcaaagaaaataccatttcgtgtataatcacttattaaaaaaatcaagtcatacccccatttacaatatgggtgtatcaaaccataatacgaatcaccacctaatccaattaaataaagtagtaccacaattgaaaaactcgttaataaagatacccgtttatctaatactgcaacaatgatcaatcctagaactgttgctggtaaataccacaaatgatagaaagttccatcgaacaaaacatctttaattatttcataaatcagattactttgattaaaataatgattataaagatttaatggtaaataaataattattgctgctaaataaatcaatagtgtctgtttaacaatcttacatagtcgttttttactgggattaagaaaatagaaataagcagttgtgataaaaaagaatggtactgcaatacgtcctaatccacgagttaaataaaaatctaaagttgggctaattgtatctaatggtgaagtatgaatcgtgacaactaaaattgcagcaattatcctaaaacagtcgattaagggataaccttttactttagacatatggcctccatgatgtaataataaaaccatcacaattatttcccgatatttgataactaccatgatcacttaagtttaacttagtctgttcattaactgctggaacataaaatacttcaactaactttccttggcattctaaaacatatggattgaaaatagaatgattttttatatataaatgatattcttcaaaacaccactgattttcttccataatttttgcatgaacaatcccaacatagcgaaaatgccatggttcctcactaattttggtaaaatcaattttatttttagaatatctctgaataaagccataatcacttgcaatatcacgaaattgttgacagatttcctgacttgtaaaatcaggacaaaagatatcaattgtttcattttttactgctaaatcaatggctagacctgtttgatgctcactacagttcactctagcaacaaacttatcaacaaactcttttccatgattttgaatagcctgattatagatcatagcttgttcttgaccgcttcttaaaccactgactaaaacaatcttatcttctgctttaatttcctgtaatgcttttgttagcatctccatagccgttttttctaatgatattgttgaatccttggcagtcgaacagttagtaatttgatagttatttgcaattggataattatgattaaccaatactaatggaccttggtaaatatcatctttatttaaagttaccatctgcatacttaagccctatcgcaacaattttatctattaattcactaaattcaaaacctactcctttcatcatctggggaaaacggctatgatcagtaaaaccaggaatcgtattaacctcattaaaaactatttcattgtttggcgttaaaaacatgtctaccctagcaaaattctgacaagctaatgtctgataaataatttttgcagtttcttgaattttccttgccgttacttcatcaattctagcgggcatatgaattgttgaagttttcaaagtatacttttcatcataatcaaaaaaacctcccgataattctatttcatctacctcaccaacagtcaattcatcgttgccaataatcgcacaacctacctcaaacccttcaacagcttcctctacaattacttcattatcgtaattaaaggcatattcaagtgcttttgttaattcttccattttgacaactttactaattccatatgatgatccagcttttaatggtttaacaaataatggaaaattcaatgctttaacattaaaatcatttatattatgtacaagcacagacctagtaacctttatccctgctgctttgactaactggtgagctcgatatttatccatacataatgctgatgctaataatccgcagccaagtactggtatttttgcaagctccattaatccttgaacagtaccatcctcaccattttttccatgcaagaccggtaaaaccgcatcaatttgctgatagattattttattatcaactatttccatcactgcttgtctttctggttctaaacataccgtcactggattaagcagttcttgattccaagtatcattactaattttttcaatttccccatcataatgaaaccactgtcctgctctcgtaatcccgattaaataaagatcatatttttcttgcggaaaattctttataatcgcagctgctgattgtagcgacacttcatattcacttgattttcctccaaataaaatagctattgtttttcttttcatattatatccttccttactactccttcgataaatctataatataaaaaaaacgctcttcattttttaatttcttcataagaaaaaatcacaaaattcccacttatttcttacatttttcttacaaaaaaatcagcattctgctgactttactgttaaatattaaaatgctttttaaaactttgagcaatcccatcattatcaacactatcagttatttcacttgctacactttttaatttaggaatagcattccccatagcaataccatgtttaaccaattgtaacatctctacatcgttgataccgtcaccaaaagcatacgtgttttcataatcaattcctaatttttgatataaatattcacaagcagttcccttagtgaaacctttgcaataaacatccattcgaatcaaacctgtatcatacggaatcatcgtaaattcatcttctaattcatgataagctgcccacaactgtgctgcactatcaaataaaacacaacagcttaccgctttaacatcactagttttaaatacctcattaacatcagttggtctttcagttgttccctgaaacatagcacgatgttttataaccaattcatcatcaagaaaactgcaccatgcaccaccgcgaccattaaacattgaacgaccattatattttgcatatacatctaattgcttctgcaccatttcattatcaaattgttcatcaatcaaaatctcattattaaaacgaatataatgtccatcattacaaatatacccatcaaattcaatgtttgccacactttcaggtacttcaccccgagctgttgcaatgacgatcttattaccttgatttttaaattcatttaaaacccttattgtctcatcagttggatgtaacatcccattaggtacattaactaatgtcccatcaatatcaaaaaacgctattttcgtattcataatgctcctccttcttttaagtataaagaaattcatatcttttatgagatattttaatattatgaaaataattactgaatcacataatcttttgcatgatcactgtaataaagagcattgtttgtatcaataaacacggcttctatccccgctaattgatttactaatgctaacccctgctctttacctaaagtaaaacatactgtgcttaatgcatcaccatcaactgaatgattattaataatcgtaactgaagctaacccattatcataactatatcccgtcttcggatttaagatatgatgataatacttcccttcaacttcaaaataacgttgataaattcctgaagttacaaccgactgatcattaatttttaattttaaaatgtcactacttcctttaggatcagtaataccaattgtaaaatcatcactattctttttccctacacaaagaacattaccacctaaattgataattgcactgtctactccctgctcaattaagtattccttaattttatcagcaatatatccctttgcaacagcccctagatctattatagtattaggattactaaaactaattgtactatcatttaaagtaattcccctatatccaatcgacgtcaaagcaccggctattgctgaagtttccggcaattttggagtatcagctttaaaatcccacaaatcaatcaattgtcctactgtaatatcaaaagtaccattagataacttactatattccaaaccaatatttataactttagcaagttccttggatattttaattggtttagttttatcttgatgattgagctgatataattcacttttgggattagtccgggaaaagagaagctcgtagtccttgcaaatagcaaaacattcatctagaatattagacgaagcacgatcatataaagtaatcgtaacttgcgtatctaaaagaagctgcgtttgacttagaggctgtttattcgtacatccacaaaatataattaagattattaaaatttttataaaccaacgttttttcatgtcatttcctttcattctggaggtagctatgtttaagaagaaagacttcattattattttcataatttttgtcgttattatcggggcactgctttttaatcatttttatttcagtcaaaaagctgcttacgtgaaaatcaccgttaataatcaagtatatcgtactgttcctctagagattgatcagacaattaagattagtgataaaaatatgatcgtgatcaatcacggaagtgtacatatgaaagatgctacttgccctgataaattatgtatcaaacaaggaacgatatctaaaaatggtgaacaaattatttgtttgcctaatcaagttgttattgcaattgtttctaatcaatataacgatgttgattcatcatccaaataggaggccccaatgactaaaagaattacctatttatctttactaatcgcaatcgcaattattctcggttatcttgaaacctttattcctattaactttggaattcctggtgcaaaactcggccttgctaacctcatcggattaattgcactatatcgctttggatttagagacgctttaatcatcactctcctgcgagtttttattattgccagtgtttttactaactactatatgtttttatatagtttaagcggtgctttattaagtttagtcattatggttcttttaaaaaaaaccaaactcttttcaactttgatcattagtatttccggcgcaatctttcataatctaggacaaatcctagtagccttaattttctatggttttaatattatttattatctaccttatttaataatcttatcacttattacaggtagtgtcattggtatcttaggccaaattattttagccaaactacctaaacaactatcataatgaattgttttttactaaaaaaaggaatttcttccttttcaaacaacaatataactctcatttttagcagcaaatgaaatgatcatgtaatattttatattgggagagaaaaataatctacatgatcacttactttactacgatagtactatactccttaaacattactttaagtcaatctttttttattaaactaattgccgattcatccattttccactaaaatagcgccagataaagaaaatacaacgaactccccaatcaataaacattgcaatccaaacaccaattaatccaagattcatatattgtcccaaaacataactaaagcataatctaaatattagcattgatgcagctgaaactatcatcgtaaacttagcatcatttgctgctcttaaagcatttggaaatgtgaatgacgtaggccagattaatgctgcaataattgcatgtaaaaagatacattggtatgcaaggtccgtcgtttcttttgataatgaatagaatgttaaaattgaaggtgttgcaataattaaaactacaattaatccagccattgaaagataagtaatttttaataactttttaacataatattttgcttgtttataatcatttgcacctacacattgacctacaaccgtcaccatcgccaaagacattgccatcccgggaataatctgcatttgagccaagttattcgaaacagcattagctgcaattgaatatgtcccaaaagttgcaattaaactttgtactaagattttccctagctgaaacatcccattttctaatcccgaaggtatcccaattgctaaaatcttttttatatacataaagtcaaatttccaatgaagataatcatttacacatacatcattatcccgatgacttaacatctttaaaattacgatacaagctactgctctggcaatcagcgttgctaatacggcaccaaataccccccatttaaaaacgaaaataaaaattgcatttaaaataatattaataacattcatgactgcactattaatcatcgatattttagagttaccaattgccctaaataatgctgctccagagttatataatgcaataaaaggatacgacattgctgaaaataaaaaatagatttctgcatttttcattacatctacttcaacatttccaaaaaccatgtgtaataatggtacattaaatgcaataactatcaccatgataattactgacaataatgctgtaatcaaaatcaactgttttgctgaatactttgccttatctttagaaccctgtccaataaactgggctgcaactactgctccccctgttcctaatgcagcaaaaatattgattaataaaatattaattgcatcaaccagcgaaactgctgatactgctgcttcgccgacgctagcaaccataacagtatctgcaaaacctactgtaattactaataattgttccacaaccaagggaataattaatttttttaatgctttgttatcaaataacattcctcacgccccctacagttacctattatacgcccatattcttttgaacaaagtaaatttcattttctggaaaagcaaaaaaacctcacaaatgaggtctaaaaacaaattattagtctaacaatgcttaaacaaagttatcaattctgttgaggtcaagtctcgatattcccctaaagctaatttttgatcaagttctattcctgcaaaagcaattcgtttaagtgtacacacttcattttgacatgatttaaacatttttttaatttgatgatacctcccctcattgatagttactaaacaatggtattcatcaagtatttccaataaactaggtaaacattgaaccttgtgatcaatcactacaccatcagagaattttttaatcaattcatctttaagcggaaatttagtagtcacataatattttttattaacatgattttgtggtaataataatttttttgatagtgaagtgtcattagtaattatcaatagccctgttgtatcaatatctaaacgccctaaacaatagcaatcttctcgcccaatcagatcaattacacactgatgatatttatcatgatttgcacaaagatagtcagccggtttattcatcatataataaacaaatggctgggcattcaattgaatatgatgatacataataatatcatccgcctttactggataacgaacatctgtaattacttgatcgttcaccctaatttccccatgcctaatcaaggttttacatatcttgtgattccctagtttattcttcattaaaacataatatagatctttaattcgactcacctccattttagaacttctttagcaaactttttagctgcctggatatcctttttatcaggatgtccaaagtttttaaaaataaaagcacttcctttacatgaaaacaccggtccataaattattcccttttctttaagctgtgctttaacattagtaaattgatctgttccaaaaccgttagcagaaaataaaataaccttcttaactttattagcatcaagttgtgctacaaacctagttacttgttcaggaatatttcctcctaaaattggacatcctaaaaataaaatatctgctttaacatcttgcacttgtttaatatttttagcatcgacttgaagttcgtcagcaattgccttcgcaattttcttattattctttttacttttatatattacttcaatcatccttctgcccccttttgacgatttttaaaaaatacttctaaatgatcgatcccatgcattaatttaattgataactgataatactgagtgatttcttcattactaaattcactaaataaagcttgatgtacctcatctgttaattcttccatatcttttctaaagcgcaatccctgtttactcattaccacacataacgagcgtgcatctttgggtgacttctctaaaatcacatatccctgcttttccaaactcagtgctaatttttttacattttgtcgtgaacaccccatcacttttgctaacatgcttaaatcaggagcatcagtaaatgaagtcatcgtagccattaataaccattgtttactcgtcatttcattgtaacgatcaaatatcgcatgtagcttattctcctgaataaacacacccgcaaataacagttttttgacccatttaggatcctgtcctaataattcataacttgattttttcatcattctctccatatccgtaactagttacttatttttattatagtaactagttaccaatctgtcaataaacaaatactttcatcagattatttcataataaaaagttataatgacttctcactataacctctaaaacagatattttaattttcgattgatcttattactttacagggatttccacaagcaacactattaggagcaatatctttagtcacaacactgcctgctccaattacacagccatcgccaatcgttacccctggtaaaataactacattaccacctaaccacacattattaccaattttaattggtagcgcttgttctaaaccagtatttctaattttatattcggtaggatgaatagcagtatatagaccacatgaaggtcctatataaacattatctcctaattcaattccaccaccatccataaaataacaattactattaataaaagcatttttaccaattttaatcttatttccataatcacacataaagggacttataagctctatgtttatgggttgataacctaacaaacttgtaatcacttctaatcttttttcataactgctaggttttatgtgatctagatcaaaacacaaatctttagctaatactctttgttttaataattcttcatcattatttgcatcataccacattcctaattccattttttcacgttctgtcatttttatttcccctttattccttcttttaaccatttcatactaatctctgcactaggataccctgcaattaaaattgcctgtgcatgtacaccataatcacctgtttgtaccactgctttacaacgatcacgcatttcataatattcaggaatgtaatgcatcgaatgaatatttttctttcccaacaaatcaaccagtaactgataatctttttgatttacttcaatcatatcttctgtgacgattgctccttcaaaatcaccacaagcaactagtgtagttactatatcctcaaaacttggtgaaccggtcactacttctacatctatatattcaacacttgaatccagtgggtatagggctttactagatgttccactgccagcatcagcaataaataacatctcaccatgacgcagactagcaacaactgctgccaaacgttcatgaagaattctcttttttggtttcacacttatctccttatttattaaaagtcttttattaattaataattataagttatctaataaaaaagtcaacaaataaaacaactgtccttgaaccgccctaatcaaataaatagatgaaacaatcaaattattagatttgaagttatcaaaaataataacttcatttattatttagaaataaacaggttaagctatgcaaatattattactatagtgttcagtctcatatttcataatctttttattttctggtattgaacatcaaactgataaatctgatgataatactgttcgtccaacaaacatataaatccatatttctctttcaattcaaggaaagatttatgattatttagatgttctttgacaatttctaatttatacgctttagcatacttttgtcccctcaacaatataaaagttcctattcagtgtttaattatttacactatctaggaggtttttatatcaataacagttgttttatttgtcttgtttaatgaaactttctctaataacttcctgtattcccaataaataatcattttcataattagcacaatacgttaattcaggcataaattcacttggtaaatactctaaacaaatcttcttgatttttaatatatcatcagcctcaatagcttcacctgttaaaatcacgattgaaggatttattatcgatgctacacaacataatgataaagccacatcttctggtgaataatcaaagcataactgttcttgttttaggtatttaaaaaatggtaaatataagatttcaccagcaatactattttctccttctattaatttaccattaataacactcccacagccaggtccagaatttaatggaaacgtcacataacaaagatcctttttattattatgtaaatagcagccataagcagtataattcatatcatttttaacaactgtctttaatcctgtagccttctcgatttcagctttaagatttacattttttaaattaggaatatctgattcaattactatctctttagaaattattgccggtacccctaaaccaattatttggattctcgaatcttgtgataaaagatatttaatgaattttaaaatatcctctaattttaaatcatttactaattctttaccctgttttagtacacttgcaagggcatcaatgatttgccagcaaagataatctctgcctctttttctttgtacaaataaacacaatgaatgaaaatattctggattcaatccatattttttagtaggacgacctttttttaaataaataatttctttttcaacaacagttccattatccaaaaaatcattaagaatcgttcctactgtagctactgtcaatcttgaataattagctagttctttttttgtcacttcttgatgtcttaataacaatttcaaaatgatttgatcatttaaatctcgtagttttccagttccaattctattcacatttatcagcccttttcaattatttttgattatatcagtatttttaaaagaaaaataccctttgtctccaaagggcttttaattcaagtacgtcattaacacattcattattatatgataaaaatgtcttttgggcaactgacaaaaagagaatatttaatttttttatttttatattgacttatagttaactctaagttctatactataaatgtagaaaagataaatacatgaaggaggacttaaaatgaaaacatggttaattacaggatgctctagcggaattggacgcggcattgctaaagcggtattaaagaaaggggataatgctgttgttactgctcgtgatacaagtaaaattgccgatctagttgatcaatatccaaatacagctttaggagtggctctagatattaccaaaaaagagagtattagtgctgcagtaaaacaagcacaagaaagatttggaacaattgatgtattgatcaataatgctggatatggatatcgttcttcagttgaagaaggtgacatagatgatgttaatcttttatttaatactaacttctttgggccaatcgaactaattaaagaagtattaccacaaatgcgagctaacaaaaacggtgctattgtcaacgtatcatcaattgcagcggttagatcgggtgtaggttctggttattatgctgctagtaaggctgctttagaattaatgactgatggtctagctaaagaattaaaaccgctaggaatcaaggtcatgatagcacaaccaggttctttccgaactaatttttatgatacttcactaaaagggactaaaaataagatcgatgattataacgaaacagctgggaaaactcgtaaagagaatgtcgttaatcataaaaatcaacctggtgatcctgataaaggtggtcaagttattgttgatacaattgaaaaagacaactatcctttccgtcttctcttaggtagtgatgctaccaagatcgtagctagtgctttagaagaaagaattcaagaaatcgaaacttggaaaaatattagtagtcaatcagattttgaatagaagtaaagcctcctaataaccggaggctttactttgattcagttattaaaatgtccagtacaaaaatgttcaattatttctaaaacttctgttaatttatctgtttcaatataaacttgagtctctttaacaaatttattaataaaattatcatcaaaatttccatcagcttgtcttttgaaactttcttttaataaatgctgtgctgcatcttgatactcaggtttcactctttttaaataatattcataaaacttagtttgtccatctttcacattccattcactccttgcatctatcattaccacaattactttaataatacttagtaatctcatttttattcattgcttatacatataaaatcatttttcctaataaaatacactcctttaaactaacgattttcacaatttccaagatatatttttccatttcataaactaacttatctacctataatgtaagttaacacgaaaaagcaataatccccggctctaagacactaacaatcaaaatcttccagaaataagagaagactgccatgattaattatatctggcatacttatcccaatttttctaatatcttggtattttattaatataacatttaaaatatcatatatatcttctaaaatggttcaattcttagtaagttcttcatcaagaataataatattttgttcatcataaatacgatgcatcaaccaaacccgctcactgattctaatgactgagatacataagatcttaacacctttatgggttgccattttcaatgacaagggttcaagtgatataactttttccctcaatatgatcaatcttatcttcaatcaatgtaagagcatgtctagcatcatatttagtaaaaatttgtggtgcttaaaacaattacatcatagtgatttcctactgcaaatagcttactataagatatcgtaaagaactagttgttaatccaccagtacaactgagcagtactctaattagtggccgtataaccagtttttatactctctactattttttcaaataccccaatcgtttgcttaagcgtcctcacttgaaaatgcaaataaaaaatgcgcaaacccaatatctagatttacacattactgttacttgattattcgaattataacaactcagtttattaaaagccaagaaaagattattttactaaaataaaaaagcctatacggcttaatagaaaaataaaaatagtcactgattaaaacaaatagtgtcaatagatattttagggagtagtgactatttatacaagttatctaccttgcactattataatctctcatgaatgttaatttaatatgaattaatcaacctttttataaattattttatttatttttgaaatttaaaaaagtgcatctttttaaagatacactttttattatcaaattattcagcagcttctgcagcttgtttgttttgatatctttcataagcaattaagaatggtgcataaattaagatagatgctacgattgcaattgcttgagatacagcacccatgatattagctcctgtagttaagaaaccatgtaagataggtggtgttttttatttcgcatacttcgtatgctcaactgacttaagtctatatgttcaaattttcaatttgaacaggtaaaaacaaaaagcaaaactttcgttttgcttaattataatcatcttcaatcgtagaatcgacatcctcttctaattcttctgtttcttcttcatcagcataaatatcattcatatcaatatgaacatcactaaatttatgacgacttcttaaatcccaggcattttcaccaaccgtgataaaacgtccgtctaaggtaatattagtataaaacaaagattctttatcttctttttgttcgtcatcaaatttcttcatttgacatacttcttcccataatttgaaaaaattaactgctgatttctttttagacattaattcatatgctacatcaaccatagacatattataatatttatccatactatccattcttgattatcctcctacatcttttctggggcactaacaccgattaaatttaaagcattagccattgtaattcttgtagcttcaactaaagctaatctttgtccacttaattcaagattatcttcatcgattacataacattcattataaaaactatggaataattgtgcaagtctttgaacataatttgtaattttgtgaggcgtacgattgatcgcactatcaataattacgtttctaaactcattaatatgctttactaattcaatttctttaggattaactaataaatcatacttatcactataatcaatgtttgctttagcagcctgtgctttaatcgaacacattctagcatgagcgtattgagcataataaactggattttcattagactttgatttagcaagtccaatatcaaaatcaaatggtgtattagcagctttagaaacaaagaaataacgtgtagcatcaacaccaatttcttcgattaagtctttaatagtaacagcatttccagttcgttttgacatttttactggttcaccattattcatcattctaaccatttgaataatatcaatatttaactggtcagcattataacctaaagcttgaatagctgctttcattcgattaatataaccatgatgatcagcccctaataaatcaactaaatattcgtatccacgatctaatttatttagatgataagcaatatcaggcgtcaaatatgtatacgatccatcacttttaattaagacccggtctttatcatcaccaaattcagttgatttgaaccataaagccccttcttcttcatatgtataaccagcagcttttaatttttcaattgttggtacgacccgatcattttcatataatgatgtttcagaaaaccaaacatcaaacgacactctaaattcatttaaaatatctttaatcttttgtaattcatattctgttcctttatttctaaagaaagcaattgctttaccttcatccatttcaagatatttatcaccatcgatctctttgatctttgttgcaatatcaataatatctttaccatgataaccatcttcaggcattgtaacatcttgtccaaatgcttgtttataacgagcgtatagagataacgctaaattatgaatttgattccctgcatcattaatataatattcacgagtcacatcatagccagcagcactcataattcggcagatactatcacccactgctgcccctttagcatgtcctagatgtaaatcgccagttggattagctgaaacaaattcaacattatatttagttccttgaccatatgttgtggtaccatatgcttctttttcttctaaaacttctttaatgattgatgtcattgcatcttttgccaagaataggttaataaatcccggtcccgcaatctctactttttcaatattggcattttctttatctaaagcctcaataattgcctcagcaatttggcgaggatttctctttaataattttgttagctgcattgctagattagttgaataatccccatgtgatttatctttaggaatttcaattgtaatactttcttgatcatattcttcaacaaatccacacgctattattgcttgtttaagcgccccttttaaagtcgcttcaattttattaattgccatcattgccctcctatcttctaatcactatatcttaattaaattaccattaaaccctcatgaagtcaatgtttttataacaatggtgcaaataatcttaagattgcttctagccaccctctaaagcgccctttaacgacatcttcaggggtcatttccttactcacagcaatcgttttcaagaagtcctctttaatatctttaattgctggaacatcatacatatagactccacattcaaagtgcagataaagactgcgataatccaaattaattgttccaacagtagcaattttatcatcacaaacaaagttcttagcatgaataaacccaggagtatactcgtaaattcgtactccgccatttacaagtggttcatagtaagagcgtgttactttaaagaccatttttttgtctggaattccaggtgtgatgatccttacatctactccccggcgaacagctaaacacaaagcatttttaatttcatcattaatgattaaatagggcgtatcaatataaatatatttttgtgcttgattaatcatatttaaataaacgtttttccccaccggcttattatccaatggtgaatcgccgtatggtaaaatatacccatttggacttatttcgggacatatataatgacgaggatgatatttatcataatcttcaaatgtatttaatgatgcattccacgttgttagaaacatcagtgttaaattccatacagcctcacccttgatcattacccccgtatctttccaatgtccatatttcactttagcattaatatactcatcagccagattaaaaccaccactaaaaccaacatttccatcaatcaccgtaattttacgatgatcacgggtattcattactgccgaaataaatggaacaaaatgattaaatgctatacacttgattccataactttccaatttttgataataacgaaatggcagcattgtcaaagagcccatatcatcatacataaaccgtacttccacaccctctttaactttttgctttaatatcgttaagactgtattaaacatctcaccttcttcaacaataaaatattccataaaaataaaatgttttgctttagctaattctttcaacaaatctggatatgtatcatcacctaaagggtaatatttaatctcactattattataaataggaaaattttcttgaactaaataattagcttgtccttttgcaatcaaatcctcaatttgttcaaccatcttatttggataaataaatggtctaatagcttcttcttgattagcaaaggcttcttgaagctttttagctggctttttattaccaaaaacaacatacaacaaaccaccaaaaaccggaaaagataagatgggaattaaccaaataatcttataactggggtcatcatcgtcattgttgataatatataaagttacgatcacacttaaaaaaataaaaactccttttaataaggtcgcatcagtaaaaatatagcgcataaataaagctagccataatatctgaacacatattaaaataatcgatacaacgatccggtttgataaaaactttagtattttcatcttagttctccaatattaaataattgagcatgacatatacttgactaatcaaattagttccatcatataattcatactttattttcacattatccccgttatcataactaattaatctagtttttaaagcaattgctccatatggagtttcatattgatttaaaatatcacgatctcttactaaatgcaaaacactagccccattatgaagtttaacttcattttcacttaattcaatttttattttattttcatcttgataactgactacaattttatcatcacctatctccagatgaccagaaccatcatatttaacagtttcttgatgttcttcatatttaaaaatacttcgataatttactttaattatttttttcattctatcaccgtgcatattataacacaaatccgtcaagaatacttttggtgatatgatgaaaaaattagtaaaaatatttgtaactattttagcaagtttagccggcatacttctatcactatatgttattgcatattgcatgggggaaccggatctaaacaagaatcgttatttaaaattatacgatgataatcaagaaatttattatcagtcgatcaacgactataccggtcattatgtaactttaaataatgttagtaattattttaaagaaagtattgtagctattgaagatcaacgcttttatgaccatcggggttttgatccaattggaatcatgagagccctcaaagtaaacttcacaaatcaaaaaaaatctcaaggagcgagtacgataactcagcaatatgcacgcttattgtacttaactaacgaaaaatcctggtcgcgaaaaattaaagaagcttttttgacaatgcagttagaaacacgtttatcaaaagatgaaattctcgagggatatattaataacgtttattttggtcatggaatttatggtattgaaaatgctgcacaatatttttatggtaaaagtgctaaagaactagatttaaatgaaagcagtatgttggctggagtagttaatggcccaacctattactcacccttaaatgatgctaaagcagctcgaaaacgacagtcaatcgttttaaacgctctaatcgactgtaaggaaattaccgtaactcaaaaacagcaggttcttgatagtgatcttaatcttgctgaaacgcataaagtagatgataatatggctaataattactataaagataccgttattgatgaactcgaagaacttggttactacaacaatacatatttgaatcaaggtttaaatgtgtatacaagttttaatcaagattaccaaaaagtagtggaaaaaagtgctagtgaatatactaaggatagtaaagtcgaaacctcgagtatcgttgttgaaccatataccagtaaaatccttgctattatcggcggtaaagactatgccagctcacaattcaatcgtgccactcaagctaatcgacaaatcggcagtacaatcaaacctttgttatactacctggcgctagaaaacggtttcactccggcaaccacatttttatgtgaacctactacctttaaacttgacgataacagcacttacagtcctagtaattttaacgataaatatgcatataaagatgttacgttagctcaagctattgctgtatctgataatattttcgccgttaaaacacatctatttttaggaactgataacttagcttcattaatcaaaaaatttggaatcaaggacgtcaaagcaaatgcctcactggcacttgggactttaaatacaaacatatataatcttgccaatatgtataattgtctcgctagtgaaggaaaatacaatcatctctatacaattgaaaaaattactaatgatgctggtaaagtcctttaccagcacgaacaagaagataaacaattgctggagcaagatagttgtttagaattatcacagctattaacatctacatttaatagtacatttagtacctatcttcaagcaacaatggcttcttatcaacttgataatatcaacgcctgtaaaactggtagtaccgatgttgataacctggctgtagcttataatccacaagtcctggttgccagctgggtcggctacgatgacaatcgtaaaatggaaacagctgatgacaaaactgttgctaaaaaaaccgttatcgatgttttaaactataccaatgaaaacaaagatgttacatggtatcagccaaccgaagacctacagcaaattgcaatcaatccactaaccggtgattttgatgaaaatggtacagtctattggtttaaaaaagactaatcccgaagtttacacttcgggatagaaaatcttatgatcatttttatttttcttagaatttacaattgccccaacaatttctgatacttctggtaaaaaccggagttcttcatcaattaatatttcaatttcactgagttcttcagtatttccataataacgatagggaacttggctttgatcatcacttacaacataataacgaggatcatagccttttttttcataaaatgattcagctaattgtttttcatgttgatcgagcagatcatgataaataaacaatcgtcgatctaaaaagcgtgtacataaatctttcaaaatctcgtcattgccttcttttaagactgtaaaataataaaaaacgatcccctcatctaatttagtataatcattttcatcgacatgtccatcaagaaacggctttaaataacgaatatctccaaaatcataaccagctgcataaagatctttcattctcctaaaaatactaattaatacctgttcataactccgggctgtggggtgataataaacttgccaatacatatgatatctggctaaaatataattctcgattgcttgtacaccagaattcttaaaaacgatctttccatcacaaacagccatcactcgtaaaattcgggataaatcgaattgcccataagtagtaccactaaaataagaatctctaagtaaataatccatccgatcagcatcaagttgactcgaaaccatctgtactaaaattttattaggatgtgttttttcaataacactacttactctatgtgaaaaaccatgatcaaatttttctaaaagatcatgtacttcggtctttccgttaataattttaattgtatatgcttcgtggtttaaatcaaaggcatcttcaaaacaatgcgaaaatggaccatgaccaatatcatggagtaaagctgcacacattactgttaacttatcataatcatttaaataggctccgattgcactattaaaaatcatttttcgagcaataaagtaaacccctaaagaatgacaaaaacgcgaatgttccgcactttgatagacctgatgcgtcccgcctaattgcttgattctccgaagtcgctgcatttcatgactattgattaaatctaatatcaatggttgatctacatgaatataattatgtactgcatcacgaaaaaccttactatctgttaatttcgtctgttctaatcgatatgccgcttgattcatcagtcttcctcctcgtattcctcaaaacgatatgtttattctacatttgggtacttctttatatcaacttttgataaaaacatttctaaaggacgaataaatgttttttatcatcatacatagcttgataaataacaacttcctccaatgtttcactatctaacccaatattcataacataatatagtttgcctttgaaatgtcgatataaatgtcgagtctttaattttcgttccacgttctcaccactttttctattttcattataatacatcttaaaagtttatgctataattgagtctaggaggtatgacatatgtacattaaaatcaatgaagcaacaaactatattaagacccaatatcatggaaaaattgatttagcaatcattctcggttcaggtctaggcccacttgcagatgaaattgaaaatcctatcgaattagattatcgcgatatcccccatttcccgatttctaatctcattggacatgccggcaagttaattatcggtacattagaaaataaaacagtaattgccatgaaaggacgttttcattattatgaaggcaatgacatggatattgttacactgccaattcgtgtatttaaaagactgggaattgataatttaattttaactaatgcttgcggaggaatccgtgaagatttaaatcctggacaaattatgctgattaaagatcatattggtttatttgccccaagcccactacgtggtcctaatctcgatgaattcggccctcgttttaaagacatgagtgaagtctataatcgaaaattaggaaaacttgctcatcaagttgccgataacaataatattagtttaaaagatggtgtctatgctttttttaaaggcccaatgtatgaaacaccagcagaaatattagcatatagagccttaggtgctgatgcagtgggaatgtccactgtaccagaagccattgttgctcgtcactgtgatatgaaaactctgggaatttcgttgatcactaataaagccgcaggactttcaaaccaagaattaaatcaccaagaagttgtagaagcggctaataaagcagaaaaagacctagttactttagtaaaaggcattataaaaaattggtaaactaaaagcatcatactaaactgaccctatagaaaacacatttatcgtgtttactctatagggaacaatttaaagatgcttttttattttatttgcacagtatttaattttcgattaacttcactaatgtctttatcatccatagcccgaagatacttaattggttgattggaatcataaacatctatttgatcgacccctaataacctatctccatcttcaccgtaaatatatccttgtcctgctaaatcaatgtttgattcatcaaaaacagaaacaagctcatatttgtttggatccttaaaaacatcatagtatctaactactgctttcacgacaactgccttaccaaccttttgatcatttaccctaatatgatttccttgataaaaatatactccctccagacgatatccatccatagccttaacttgctgctgtgcaaaatttgccgcccattccttatcatatgctattttttcttgacaggctgtcattataaaaagaaatagtaataaacaaataaatttctttaattgttgcattatcctctcctccacaagctattatatcataaaaatatttttttattttaaataatctttatattatctaagttctaatgatatttacaaaatctataaaaataatacaaatcctaataaatactagtcatttaaccgattaacggactaatcgtaaagctcattatttttaataaaccatgaaaaaatttcaagtcttgaaaaaacaaaacatttatttgaataaacgtgtatgctttatgtgtaaaataaatatacggaggaaataagatggaaaagaaacctgtaaaaattgtaacaattggtggaggtagtagttatactcctgaattaatggaaggatttattaaaagatatgatgaacttccaatcaaagaaatttggttagtagatattgaagctggtaaagaaaaactagaaatcgttggtgctatggcacaacgtatgtgggacgcttctccttacgatgttaaagtacatttaactttagatcgtcgtgaagctttaaaagatgctgatttcgttactactcaattcagagttggtttattaaacgctcgtattaaagatgaaagaattccattctcttatggtatgttaggacaagaaacaaatggagctggaggaatcttcaaggcatttagaacaattcctgtaatccttagcattgttgaagacatgaaagaattatgtccaaatgcatggttagtaaacttcacaaatcctagtggtatggttactgaggcagttatgaaatatggtaaatgggatcgtgtaattggtttatgtaacgtaccagttggggctatgatggctgaaccagaaacaatcggaacaactttagataaattaatttataaatttgctggattaaaccatttccactggcaccgcgtttttgatttagacggtacagatgtaactggaaaaatcattgatgcaatgtatgaaggtaaagattctggtattcctgcaaatattcatgatatcccattctttaaagaacaattaaaacaaatgaatttaattccttgtggatatcatagatattactatcgtcaacaagaaatgttagctcatgggcttgaagaatataatggaattggaactcgtggacaacaagtaaaacaaactgaagcagaattatttgaattatataaagatccaaatttaaattacaaacctgaacaattaactaaacgtggtggtactcactattcagatgctgcatgtgaaactatcgcatcaatctatgctaataaaaatactcaccttgttgtaactactaaaaacaatggtgctgtacctgatcttcctgctgattgtgctgtagaagtatctgctcatatcggttcagctggagctttagctatcgcttttggaccattagaacctgctcaacgtggttggttacaatgcatgaaaaatatggaattatgtgttgaagaagctgctgtaactggtgattatggattagctttacaagcatttatcttaaatccacaaattccttctggtgaaaatgctaaacgtgttttagatgaattattaattgctcataaaaaacacttaccacaatttgctgataagatcgctgaattagaagcagctggtgttacagtaaaagatgaaatcgctagagatttagactaaataaaaaattcgtgaatttgatatgatctctctaaaatagacaacttaaataaagttgtccatgaaaagagggatcttttcttatggcacgtaatatacaataaaaaaagatacaagcagttttagagtataagaacagaattaaagaaataaaacaaataataattcaagagcatttaaatagtaaagattctttgagagatttaagcaataaatacaatactcattcttcttcatctttatgaagttgggctatcagttataatagtcactaaaaattaacagattatgatcctaaaggagatgtctacatgaccaaatcaaaaaaagcaacattagaagaaataattaaaattgtataatattatttagattatgagaaagaatataaatcagcagctgaactttttgaggtttcttactcacaagtatatcaatgggtaaagaaatatttagaattaggtgaagaaggtctaaaagacaatagaggtaagtgcaaagatgaatcacaattaaatgagttagaaaaattacaatatgaaaatgaacgtttaaaacaccaatctgaacttaaagaaaaaaatattatcttaaaaaagttgaaggaatctaatattactcaaagtatgtcaagagttggaaaatgtatcgataacggttctgctaaaagattttggagaattattaaaagtgagatgtattatcttaacaaatttaattctttcaatgaattaaaaaaagcaattgaaacttatattgacttctacaataacgaaagatttaataataaggtaccaatgaaagtacgtttagaagctctaaatggtactgaaaatccagcacaatatcctaccaataattcattaaattacgcaatggtataataaaagatgctttaccaaatggaaaagcatcttttattttgttatttcttatttcttgttggtttgtacatcccacccggtgaataattatctgcatattttttagatacttttttcactaatgatactacttttttctttatagccatgttttttcacctccatacttacacctgtaaaaaataaagtaaaaccaattatcatgcttagtcgtggttctataggataaattaatccaatcacagccagacatccccaaaaaattaatttacttattttcacattccgtgcttcatgattttcttgccacataaatgctttagcagcaataagtattgccataattagaagatagctattttcaaaatccgcaaaatagagcgtaccaagatataacaaagtcgttaaaaacatacagcgataaaaactatcagcatgataaccgtctacaaatgtccgtaatccaactaatgcaataataaatattattgtttctagtaccatatttctaaaaatgccgattgctaacaacaaaaaaaataaaatcatttgagtcaaaatgagttcaataccaaatcttacttcatcaatttcatcctcagtcacattatcaacatctaataaaaatctgcttattttttcacaaaaacgtttcatatctatcctccatgtccattatactattaaatcttcctaaaaatattttcaatgtactaaccggtcctattttgttattaaatacttctaaaaaaattaaaactttgtgccggacaatagcacaaagctttaaaaaaagagattagattattaattcaaacttctatccaatagacgtttgtgagaaatagctataaatattacttgcggccatgtagtaatattataacttggagattatgtatagaaagacaatactttttattttattattacatctctcccataatctattatactacacaacctaacagcttgcggttttatcctttttttctacactaacggtcaatattatgacataaacggctttttaattatcaacattcagtaaaatatcgcaatgcaccttgttattttcatagaaatattccattgttccatgataggtttctacaacctctttaatgattattaatccttttccatgatctcttccttttttactttcataattaagaggtctattagtcgaatttattatgctgatcaaaagcatattgcctttactaaaaattttgatttcaactatcttctccgctgtttttaaagcagcttcagtagcattatctatcagattaaataatagagaacataatttgtcttgagcaatattaacattgcgatcaatcactgcatctacaacataattaacttcatcgttattgcgaatcttcgcatttaaacaagcatctacaaaaatatttcccgtacgtatcaatttaactggagcatttaaatcttctttaattgcttttaaatattggttagcgactgattctgtttcgactacttcttctaggacttgtaaatgattattaatgtcatgcttaaacttataaagacgttcttgttctttttctaattcactaatatgacggcgagttgtagcatatgaataatttgctaactctaactccttattacgtaaatacatacgggaagaattgatgatataattatttaccaaaatcatttgaacacctgctaagatcaatataaaaaagatataaatatccccctgttcaactgataatacgtttaaaatcagtacaataatcacttcaacaatattgatcaaacaaaacgaatataaaaattttttaggtaactgatgttccacaaaatcacgtttttgaaccgcatatttgcatatcaatgctgatgatatatagtttcctaaaggaaaaacaactcgcatactcccccatacgatatccaaatatgtattgtcaaaaatttctagcgccactgcaatcataactgagccgacaataatttgaattgaataataaattgtagtgataaacaaattattaagcctaaatctcttaaccaataccccacaataaataaaatccaaactaatacacattaaattaccaattacatataaccagccattatgtggtgaagtatacgtaacaatattcaaaacaaacgtataacttaatataaccataatatttctaagcatgttttctttacgaatatatggataggttaatgaaataacataacttaaagcaacaacatatatcaatgtatataaatactcaataaaaaaattaatcatcactctttgatctcctgcattaaaagattaaatacatctttttttcttcttctactaatttctagcgattcatcaataccttttaattttaaaatatatccattcatcgaaacaaccatattaatattgattatctgacttttatttatttggacaaaattatctggtaaatactgattaacttcttcaagcgtcatataaggaatatagaaattattatcattagtataaaaatgtaagtatctttttactgattcgatataaataatatttctacttcgaaaatgaaaaatctctccctttttcttgatccagatatcatcattttgttgtctacgatttatcgctttaagcaaggttggcgttaactttgtttctaattctgatttaagtaaatatcctgctacattaatatcaaacgcctcctgcattttattttcataattagttatatatattatgatcgtattttgtttcaataatttttttgctacctgtattccactcattgttggcatatcgatatctaataaaagaatatcaaagtttttaccacaattaaaaaactcttcaacatcttgaaaaagttcaactgtatatggttccttaattctagcctcctctacataccctctgattctaagtagcattgaccgctcatcatctagtatacctattttcatctttacacctcatttatttattatacttgataaaaccttttttgactaattaaaaaaggcccttaggccttatcctgttgctttttttcatagtaatttcttaccagcacttgtgttttacgaatatgattttgaattttttctttagctaaatccttatcacgagctaaaattgcctcataaatttctcgatgctcctgtgctgctgaaattaaacgatccggttgacgaattgaatgccttgaagttacatgaatataataattaatatctgttaataattgctcaaaatactttgattgggtacaacgataaatagcctcatgaaaagcaatattaatttcattaaacttctcttgatcacctttttcagcataaaattccattaaatcatacacttcttttatcttttcaagttcctcatcattaattcgctcaattgctaattggattgctagcccttctaaagcataacgaatttccaacatatcatcgatatcacgatgagaaaaccctagtacataaactcctttattaggaatacttttaaccaaaccttctaattccaactgttttagagcctcacgaattggagttctagaaatattcaactctttagacaaagcaacttcatttaatttttgtccttgagtatattcctcatttaagattttatcacgcaaaacggtgaaaattttatttccaagcgacccatgtccggtattttctaataaattctttgtcattgtttaacctaactttctgatgatggctgcggtgaactcgtctgttgaagcactacccccaatatcaggtgttacaatagttccttcttcaactacagctgctaaagcctcacgcaatttattagcatcatctaatttccctaatgcctctaacattaatgcaaatgctaataataatgcactcggattagcgatacccttaccagcaatatctggtgcacttccatgaacagcttcataaattctaaattcatcaccaatattcccacttggtgcaaatcctagaccgccaactaatccagcacataaatcagaaacaatatcaccatataaatttggtgcaactaaaacatcaaaagtttctggacgaattactaattgcatacacatgttatcaacaataacctcttgtggctcaatatctggataatctttagccacatctctaaacgcttctaaaaataatccatctgtatatttcataatattcgctttatgaactgctgtcacttttttacgtctattgttcttagcatattcaaaagcataacgacaaatcttttcactcgcttcacgagtaattaatttaattccatttgccatatttggattgatcatatactcaatccctttatataaatcttcggtattttcacgaatcataaccagatcaatgtcttcataacgagaattgattcctttaaatgatttgattggacgaacattagcataagttgcaaactgttgtcgcaaggcaacattgacacttctaaatcccgttccaatcggcgttgctgtcggaccttttaaagcccatttatattctttaatagcatcaacaagtcctggttcaaaaacttctttcgttgtagctgcatattcagcaccagcctgatattccacccattcaatgtcaagcttcatcgctttagtgatatcaacgacactctttgatatttcttttccaattccatcaccagggattaaaacagctttcattaaaattcacctcccaattctttaattgcatttaataaaccaccgtaattaatcattactttttcacgaggtgataatgttaattcagcctcgattgaatcattagtagtttcattaattacttttactttaccattatgttcaacaacatctttgatattaacgattttataactatcttggtcattgaagaaatcttggtctttagcttcaataactaaaggtaaaataccattattaattaaattagaacgatgaattctcgcaaatgatactgcaaagattgctttaatctttaaatagtttggtactaaagccgcatgttcacgggaacttccttgaccataattatcaccaccaacgatgaatcccccattattagcaattgcacgatcatagaattcaggatctactttactgaatgaaaattttgctaaatgtggcacatttgaacgatatggcaataatttgctatctgaaggaacaatatgatctgtcgaaatattatcaccaacttttaaaacaacttttccactaatttcatctgtaattttttctccacgtggaaccggtttaatattaggtcccatatatacttcattattttcgtcatattcatcaatgaagaaatttccatttttaataaatggagtatttggcacctcttctaaatacatatcatcttcaaattcttctgacatgtaccctttaattgcgctcaatgccgcaatttccggtgatactaagtatacgcttgcatcatttgttcctgaacgtcccttgaaattacgattaatcgttcttaatgaaatcccttttgagagcggtgcttgacccattccaatacatggtccacaaccacattcaagaatccttgctccagcttgaaccatatcagctaatgctccattttgtgaaagcatcgcaagaattgaacttgatcctggcgcaataactaaagaaacatgatccgcaactttgcgtccttttaaaatcttagctgccttcatcatgtcagcaaaagatgagttagtacaacttcctatcacaacttgatttactttcattccttcaagttcttttactggtactaccgcatctggactatgaggcttagcagtcattggcactaatgcacttaaatcaacatctaattcttgatcatatgtagcatcttcatcagctttcatttcaatgtaatcatctactcgcccttgttgtgctaaatattcttttgttctttcatcggtcgggaaaactgatgtagtggctcccaattcagcccccatattacaaatcgtagcacgatcagtcaatgataatgaagcaactccatctcccgtatattcaataatcttattaacgccacccttaaccgttaattgctgaagaatatataaaataatgtcttttgcacttacccatggtgctttttttccagtcaaattaactttaacaacactaggacattgtaagtaatatttacctgttgccatcgctactgcgacatctaatccccctgccccaatagcaatcatacccattgctccacaagttggtgtatgtgaatctgatccaactagagtctttcctggttttgagaagttttctaattgtaattgatgacaaactccattacctggttttgaaaaaacaatcccatgctttttagccacactgcggataaattcatgatcatccatattttcaaatcctgtttgtaacatgttgtgatcaatatatgccactgctttctctactgcaacatgtttaatattcattgcttctagttgaagataagccattgtacctgttgaatcttgtgttagtgtttgatcaatttgaattccaatttgttctcctggaacaagatttccatctttaagtttactacttaaaattttgtatgctaaattcatacccatcacgatatacccccattattcttatattgcatacaattatacaaaaaaacaatcttgattacaaccctttggaacaaattttaccacaagatgtactaaaaataaaacactttaataaaaatctattatttacttgatttaatcgagtaatttttaattacacttttttaataataaatttgtgaattcctaaaataaaatatctacttttcttcttaaaacaaaagccttactataaatatcaatgaaaatatgttagaatacattgggtgataaaatatgttaatagaatgttcaaatataacaaaatcatttcaagggattcccttattaaaagatataacctttaaaattgatgatcatgataaagtcgcaattatcggagttaatggtgctggtaaaactactattctaaaaattattgcgggcgaagaaaactatgatagcggtgaccttttttgtaataaagaattaacactaggttatttaaaacaacagcatgacttagcgatggataaaacagtttacgatgttggccttgatgtttttgcaccattgatcacaattgaaaatagactacgtcaattagagaatgaaatgacaactgatcatagtgaacgtattttaaatgaatatgatcgtctaactcaatcatttcatgataaagatggatatagttatcccagtaaattaaccggcgttttaaagggactgggctttagcgaagaagaattcaatttaaaagtttcaatgctatctggtggtcaaaaaacacgtttagctcttgctaaaatgctgcttcaagaaccaaagctattgttacttgacgaacctactaaccatttagataatagtgctattaatttcttagaaggatatttaaaaaattatcctcatgcaatcatcacagtcagccatgatcgttactttattgatcaagtttctaataaaattgtagaagtcgaaaatggaaaatccaaaagctataaatgtaaatataacgaatattcaattttaaagaaaaagcaaagagctgttgatttaaaacattatttaaatcaacaaaaagaaattaaaagaattcaagagagtatcgatacactaaaatcatataaccgtgaaaaacaagttaaacgagccgaatctaaagaaaagcagttagctaaaattgaacgtattgacaagcctgagaacttgccagatacaatcacgattaattttaaaccaaaacgtgagtccggttttgatgttttaaaaatagagaacctagctgttaaatttgatgaaattttatttaaaaacattgatatcgatataaaaaaacaagagcgtattgctcttgtcggggataacggtgtgggtaaaacaactctttttaaaactatcctcgatcagctaaatgcttatcaaggtaaaattaaatttggtagtaaagtagaccttgcttactatgatcaagaacatagcacactagcaatggataaaactatttttaatgaaattagtgataattttcctaagatgactaatactgagattcgcaacagtcttgccttatttaacttcaaaggcgatgatgtttttaaagaaatctctttactttctggtggtgaaaaaggacgtgttgtacttactgaaatattattaaaacaagcaaatcttttaattttagacgaaccaaccaaccacttagacattgcttctaaagaagttcttgaagatgccttaaaccaatttgaaggaacaatcttctttattagccatgaccgctatttcattaataaagtagcaactcgtgtgatcgaattaacgagcacaaaagccatcagttacgatggtaattacgatacttatttaaatcataaaagcgttgctaagccgctcaaaaaagaaaatgttgattatcttgatatgaaacagcaaaatgctctttatcgtaaacagcaaaataaaataaaaaagatagaaactaatatttctatactagaaaccaagatcaacactttaactgaacagcttcatagtgaagaagttctaaatgattatcagaaatataatcagatcaatgatgaaatttccgaattagaaaatcagttaaatactttaatggaagaatgggaagccctgcaataagggctttttatattcttttaactccaagaatacaataattttcatctacacctgagccttcacaatcaacatactcaacttttactacacaactgatatttgtttttcctagttttcgtaaagaaacacaatccccctgctcaattccctcttctttacaaacaactaaatggttaatcacaccgttacagattttatcaaaatattggctgtcaacctgtaaactacacatactaaaactcctttcaaatctttaaatattgtttatagtgatcagatccatcaatttcttcaattcgtatctcaatcgttttttctaaatcctctacaattgttttttcattaaccagatttttttgactaatccaagactgatatagtggataaattataaatcttaatgttaaagcaattgataacaatccgaaatctattgatacacctaatattaatggtttaagtaacattcaaccatacctcctagtattgccattcactcatgctttgatactatctaaatcacaataactaacacatatatatgctctaaataatttattatgtcagttaaataaaacattactactatacttaaccatatattgcattacttttttgtctaatctagtggaaataaaaatactttaattcttcaatccaaatatttaaataaaaaaagagcaaaataattaaatatcctgctcttttctattaaccgtttagtaattttatttaatcgatttctttaccagatccagctctttgctaatttccaataattccttaattgcaatttctagattttgtcttgggtgctcttctaaggacttcttagtcgtactaattctctcggctatgttttctaaactttccatgttaattctccctttttctttattctaccattttactatactctatcatgccatatttttgcagaccatatcagactatgataaattaaaaaaatgtccaatttaagctacattaatttaaattaataataactttcttgctctccatgataatatacttttgataaagaaatatacaaaaatctcttacgattacaattataacaaattcatcacattagtccaagataaaaaaatttttctctagtttataaaataaagcaattattagaataaaatgcatatttttcatttttaaaggttatatttagctaatatgtattacccttacacttagtaaatctttgattttaccatccctctttagtgcttttttcatattttggaaaacggttccatttacattactttaaggtataataaagccgtaaaaacaaggaggaaataaaatgttacacaaaaaactaaaaccattcccaagtgattttttatggggagcttcaacatctgcttgaaaaagctgtagatgattttaatcaagactggtatagtgtttatggagaaaataaaggaatttgtgatttataaaagaaatggtggaggattccactttttctttttattaaagaaaaatgagtggtttaagaagtttaaaaatcagtggtgaaagaatgctcagataactgatgataaatagtataaaatgttgatataatcgtataatatttataagtcataatatttgcatttggtatcaaaaataggtatgctatttattagagaaaaataaaggagagaaataaaagatgttagaagtgggaagtattgctccagattttaccttattagatcaaaatggtgacagtgtttcattgagtaattttgttggaaagaaaataattttatatttttatagtaaagataatacgccaggctgcactaaacaagcttgtggatatgctcaaaactatcctcgattcaaagaaaaagacacaataattattgggattagtaaagatacggttgtatcacataaaaaatttgaagaaaaatatcagcttccatttattttattagctaatccagaattagatgttttacaagcttatgatgtttggaaagaaaaaaacatgtatggtcgaatggttatgggtgtagtgcgaactacatatttaattaatgaagaaggtattatagaaaaggcatttacaaaggttaaagcagcagatgatgctgagcgaatgttaagagagattgagagtgaataaaagacagatgcaattaattattggtattttagttatcattattattgttttattagtgtatcgtaatcatcgccaagaaactgtttatcaaaggatttcggcgagtgaagctcaaaagattatggatgaagaaagtaatattatcattattgatgtaagaacagtagatgaatataagaccgggcatataaaaaatgctatctgtattcccaatgaattaatttctaataaagaaattgcagagttaccagataaatcacaagaaatattagtatattgtcgcagtggaagtagaagtcgtcaggctgcaaacaaattgattaaacttggttatgaaaatgttattgattttggtggaatcattgattgggatggtgaagtagttaaataagagggtgctatttgtagtgaactttaaaagttgagtgagcaactagaaatgatcactatattttggcacctttttcttttatctaaatagagattatgctatactacatcctgataaggaggctatgatgataaaattaattgcaacagatatggatggaacatttttggattcagataaacgttttgatccggaatttattgatatattttataaactaaaggaaaagggaatcaaatttgtaattgctagtggtaatcagtattatcgattatatcaaaaatttttaccattaagtgaacaaatgtattttattgctgaaaatggttgttacatcgcagagggagcgacagaattgtattgtaatacaattacacacgataatgttgaattgatcaaaacagcattagccccatatgataatttatttatgatcatgtgtggtcggaaaggggcttatgtcttaagccgtgataagcattttgaatcattggtgagattacattattgtaattatcaatttgttgattcattcgatcatatcgatgatgaaatcatgaagatttctattaatgatccagaagaacagatagaaaaatatttgcaagcattggagccgcatttaccagtcgcagttaaggttgtaacagcaggaaatatgtggatggatattcataatcgtgatattaacaaaggtgttggaatgcgttttttacaagcaatctatgaaatagaacctgatgaatgtatggcttttggggatcaaatgaatgattatgagttattacagcaagtgaaatatggttatgccatggataatgcagttctgccaattaaggagattgcttatggtacaactagatccaatgatgaacagggagtcttaattaaaattaaagaagtattggatcttgcctagtattgctaggctttttttttacacgaaaaaaggtaaactaccttttattaataactaaagttagtttacctattactctaaagccgacttgactttcttgatttattacaatgggtgtatattcaggattagctggttgtaatataatgcagtgattattatcatcacggtagaattttttacatgtagcaacattatcatcgattgtaaagcagccaacctcaccatttctaatttgattacttttttcaaatacaattaaatcaccttgattgatattttcattgatcatgctgtcaccatcggcatattgacaaaaatattctttactgggtgaaagtaatgtttcaggtaaggatatatattcatcaacattgtcatcaacaaaaagaccagttccacaactaatatcactgtataaaggaatagtaattgaatcagtaataataggttgattgctctcgtcaattcctaaaaagtatgaagcaggaacatcaaaaatttcagatagtttttgaatcgtgtccttttttaaattctcaactcgattgttttcatattttgcgatggctgattttttaaccccaagtaagttacctaattgctcttgagttaagcctttttctttacgtaatttttttattcgttcaccggtcatttgtattcactccttgtgtcttaattttactattaaataactagttgtgcaatcattaattaacaaaagtgtcgaaaaaagatactttttgttgacaaaataatggaatggatgtatattaaaagtgtcttataaagacacttaaaaaatattgatataaaaagatgaataaatagatactaatgatggagggaaagattatggaaaacaaagaaatgaattttagtggtaaaggaattttaacggttattacggggataataattatgggttctacgattgcaaccttaagttcttatttgttggatttaattatgctttaatgcgcatactagtaatgaggtgagctgctaagtgaaacgcagagataaagaaattaaagatcaagatgaaattgattatgaaaatcatattatggaatatgatgaccaatatcttgataactccaatgctcaagaatagagaacagcactttatggtgctgtttttttatggtatagatatgcagagaattaatgtttatcgtgtagttattaactttcaagttaccaaatagaaaggtaaaatgcacgaagctaataaatgattatgatataatagatgtattaaagaaaggtgtgaaaagcatgaaagttgaattaaagattgatcctaattgtcaagagccttgggcagtgataaatgtagctaagctgacaccatcgcttcaagctgcgattacaattttggaaaaagagtgtgaagaaatgatttttacggctcaaaacaatggtaagatctatataatcgatccagtaaaaattgagctgattcgtactgaagggcgagaattagcattatatgatttgaaaaaagaacgctatgttttaaataaaccgctctatgaagtacaagaacaattaggaaaagattttgtacgtatatcaaaatttgcaatcatcaatattaagcgtattaatcatgttgaagcatcttttaatggaacgatggaaatagttatgaagaatggtcttgaagaaatcataacccgtagttatcgaaaactgtttaaagaaagattggggggtgtagagaatgcgctttaaagatttagtgagttatttttttggtgggattgcttggggatgtacgtttttggtagtaataaatctaattggttatacagtgattggcaacacgtttttagaacctttgatggaaaattttgtcatgcatgcagtaggagcaatggtagttggagtttgttgtggttcgacttcatatgtttataaaattgaaagtttaagtttaagaaaacaaatagcttttcattttacgattgggctgggtggatatttattaatagcatataaattgggatggatgccaattagcaatatcggctatgttatcacttttatattaatggaattattatctttacaagtatttggacgggtttttatttttataatcgaaatgaagctaaaaaatataatgctaagataaaagaaatagaaaaagaaaatgataattaagattattgttaaaggaatatcagaagtaaagctttcatgatataatgaataatagtgaaagtgagtgataataatgttaaattttcgttatgctgatataaatgatttagattttttagtggagttaaggatacgtgatttaagactgttttctaatcaggaaatcttaccacagacaattaacaagattcgtgatttctacaaaacaggtattatcaatggtacctgttttacattattaggatttgataatgaattattggctgcttcaggaacattatacttatattccttaatgccatcaaatgaaaatccttcaggaattatggggcagttaacaaatatatgggtagatgaaaaatatcgtcatcaaggtattgctagtagaattgttagtgacttattaacaaaaggacaaggtaaatgtggaatgatttgcttgaattcttcaaaagatgcaatcgcactatatcaaaaactaggatttaaaaccaaagaaaggtatatgataaaacaatgggactaataattaaaaagcctgatgatgcaatcatcgtaaataaaaaagatggaactcatgttgcctattatttgtttgacgagtatgaagttcacttaaacagtttaccaccgcaaactgaacaagtatggcattttcatcaagctatcgaggaagtaatcttaattattgaaggagagatagaaatccactatttagataatgataagagaatgcggcaaagagttcagccaaatgatttaatattagttaaagatagtattcatacattgattaatcgtagtacgaaagaatgtaagtttgttgtttttagattagtacttgatggtaagaataaacgtgatctaatcaagaatgacaaaaaggttgtaaatatgctgtagaattgtttccaaagaaacaatataaggaggaagaatatgtttattgatttaactttagaagttactccaaaactaactcaggatgctaaaggaaatgaaagtaaagctaattttgggcatttaggcactcattttgatgtgatgaacaaagagtttccattatcttatttagaaagaaatggagttatttttgatgtccgaggtattgatgaaattgaagtgattgatttggaaaaaattagatctggtgattttgtaattttttatacaggatttttagaaaaggcaggatatggtactaaagaatattttcaagcccaccctcaattatcaaataatctgattgaaaaattgttagataagaaagttagtattattggaattgattgtgctgggattcgtcgcggtaaagaacatacgccgatggatcaatattgtgctgatcataatgcatttgttgttgaaaatttagataatctagaaagtttattaatgcaaaatgagtttactataaatacttatccgatgaaatttagtgaaatgacaggcttgccatgtcgggtagttgccaaggtagattaaaatgcaagtgattctcgatttatttactgaactatacgaaaaacaagatatattatcaaagctaacccaaagcagcagtttgcaaggttatggttattcagtaattcattgtcttgatgcaattggaattcttgatgggcctaacattacaaaaatagcagaacacctaaaaatgactcgtggggaattagtaaaattatcaaaaaattagtttctaataatttaataacaacatatcaaaatgataataataaaaaagagatatattttaaacttacagttgccagagaacatttatttttagagcagcaggcacgacatcaaaagtatattgaacgtgatataacttttttaaaatgacaagatgagcaaaaaatgatagttgttaaagaatttttaactgtaataattatttaaaccatcaaattgaagaattaagcaaatagcagtattgttcagaggcgctagttttattaacaaaattagtgcctgttttattaacttaatagattgattgtaaacggatacaaaatatattataatacttatgacaatacttgtcataagttaggggaggtgctcataatggatgagttcttgcagggaatcaatgcatcgatttatttaaaatggatattaatgcaaaacaatcattatagtttaaatatcaaagttgatgacaatgataataatacgatcatcatcagtaatgaaatagtaattgggaaaataatttattatggcaagggaatttttgaggaagagttaaatgatcgtcaaacaaaggaaaaaatcttttatcttcattttcaattaacacattttaatcatgcagtggagttgtttaaagaaatgattaattgtgcattagaagcaactaatcggccgcaaataagagttttattatgctgtagcggtggtctgacaacaactttatttgcaagtaaaatgcaagagctggcaaaattggaaaatctatcatatgagatttttgcaacaggatattcacgcttatttgagattgctaatgattatgatattattttaattgcaccgcaagttgcttatatgctgccacaagctaagcgacgtttgccagataaagaggtagtaacgataccaacacgcatttttgcaacaaatgattattcaggagcattaaaaatcatttatgattggtatcaaaacaaggaggaaaaataacctatgaatatcagtaatactaaaaatctacgacaaataaatcgggataaagtcatggatatttttatggagcaagaaacttgtactaaaaatcaattagctttagcgactgggctaagtttagctacaattacaaatattttaaaggaattgctggcaagtaatgaagtattaaaagatggtgagttagaatcgacgggaggaagaaagagtgttgtttattctttgaatagcgattattctcggatgctaacgatttcggttaataaagaataccggcgggtacacttgatttatcgggtttataatctggcagatgaaatagtttttagtgatgaagtaatcaaaaaggaagttaaagttaatgatatttatgatattattaacatcgttttagctaagtttgataatataaaagttattggaataagtatgccagggattattaatgatgggcgagttacttcaactggattaacaaattttaatgatattgatttatattcattactaaccaataaatatagtcaagtgatcatattgggtaatgatgtaaatacagcagtaattggtttttatctagcagaaaaaaattatgaaaatgtctgtctgttatttcaaccaggtgaagggtatggtggtgttggaacagtaattaacggtcaacttgtaacaggtaaaactaattgtgctggtgagatacaatatttacccttgagtcaagatgatcaattgaaattgcttcagtctccccacggaacgattgaattgttgagtaagattgtaatttgcttaactgcgatcgtaaatcccgaaatcgtagctattagttgtactaatcttgagcgtgctagtgatttagatgaaacattgaaacagatggttccggctaaatatcttcctaagataaaaaaagtaactaatttaagtgagtatattttaattggtttacaactgatttgtaaagattctttaaaaacaaatcttgtcataaaaaaacaatcgattatttaagcatctataataaaagatgcttttcttgttaataatttaattggtgataagatgtcagaaaaagatatacaattattggtcatgtgtttaaaggaatatattaaaaatattgatagtgaaaggtttaaacaactatttttaggttatgctgaatacatggcacgaaattatgggcaggattgtttgattgatgaatatgatttaatgatggaacaagtagaaaaatttgttgatgagcagcatttggatataaatttattacctccatacaagcgggatgttttttatcgattcattaaaaatcattattcaaaacaagatatcttaagtttatattattttaatgatgagattggtgctttagaatgttttattgatatgattgatagtaagtatcaataaaagccttgtattatcaaataaatttgatatgattatatagaaacgaggtggaaggatgtataaattttcttgctaaaatttaataacagtatactttgagttactgtttttgtgcgcgagaaaatatatccttttaactaaatccgattctaagattctatttaagctacgagtgtatattttcttgtagctttttatattgttaggaggaatggaaatgggtttattagacgtaaagaatttatcgtttaaatatgataatcagattgaaaaggtatttgataatgttagttttcaaattgatacaaattggaaacttggattgattggtcgaaatggtaaagggaagactacgttgttagaattattgatgtctaaatatgaatatcggggctatattacccctaattatatctttgactattttccgtatcatattgaaaatgaaaatattaggactttaaaaattgttgagaatattcttggtgaatttgaattatgggaagtacaaagagaattatcattacttgatgtggaaaatgaggttttagaacaaaatttcgctaccttatcaaaaggacaacaaactaaagtattattggccattcttttttgcaagcctcatgattttattttaattgatgaaccaacaaatcatttggattatcacggtcgacttttactaagtaaatatttgaaacgaaagaaaagttttatattggtaagccatgatcgtgattttttagatcgttgtatagatcatgtcttagctataaatcgtaatagtatcgaagtgataaaagggaatttttccctttggtatgatttgaaaatgaataatgataagagggaaatagaaaagaatgagcagttaaaaaaagatattgggcgtttgaaaaaggcagctcgtcaaaatgaagattggtcaaataaagtggaagctactaaaagtgtaaaggttgctggtttaaaaccagataaaggttatgttggtcataaagcagctaaaatgatgcaacgctctaaaaatattgaacgacgtcaaagtaaagcaatcgaagaaaaaagtgatttattaaaaaatattgaaacaatcgaaaaattaaagatctttccacttgaatactcaaaacagcaactatgttattttaatcatgttacgattagttatgataaacatattattgttgaaaatttaagttttgatattaatcagggagatcgacttaatcttgctggaaaaaatggttcagggaagacaagtataattaaaattattatgaaagaaagtaataattatcaaggaaaggtaaatattggaaataatctaaaaatagcgtatctaagtcaagatgatagtcatttaaaaggaaagctggatgattatgcaaatagtcttgatattgatttaagtttgtttaaagctattttaagaaaattagatttttctcgcgaactatttactcaggagattagtacttatagtaaaggtcaaaagaaaaaagtaatgttagcgggagtgttatgccaagaagctcatttatttattttagatgaaccattaaattatttagatatttttacgcgaatgcaggttcaggaattattgctaatatttaaaccgacagtattatttgttgaacatgataaatatttttgtgatcaaattaaaactaaaacgcttaacttataaagaaggtcaagtgagttagaatatgagaagaaaacaaaagtaataatgataattaaagactatgtaaatcttgaagcacccccccttttagttggctatgtcgagcttttaggggcgcttcattttatatggtctttaacaattatttaggataagtcataccttcatggtaatagacataacgatctcgtccattgtgtttagcattatatagagcaatatcaactttattatataattcagtaaaagatatctctggtcgattatcgatatgaattcccatagaaatactaatttctttaggatagttattggcagtgacatattcatgaatttttttaattaaagcatctgccttttcgcggacgatctctttatcatatatatctttgataaagattaaaaattcatcaccaccaattcttccaattaaatcacttgctcgaaagaaacgcttaattatttttacaatttcaattagaaaacgatcaccgatgatatgaccataagtatcattgatttttttaaaataatcaatgtcaattaagatacaagcataggaaagattattttttaagatatgacaatattcttgaatcgcgctagtaatatataaacggttatatgttccggttaggggatctgttattgactggtgttttaatcgtaattctgaggaaatatcaacaactttgccgacaactttagttaatttattatcattatcaaatatccgtcgaaaagttagacggtaccaagtataactttgtggtgcgattgcaaaacgatattccaatttatataattcattagaaacttgatttgataaaattatcttcaaatcctttttaaagcgttcgatatcaccatgatataaatgagtattttttaaatcaactgtcaaaaaattagtcaatatatttttgactggagtatcagcttgtagctgttggtatactagtgaattattttcaacatcatattcaaaaataatatcatcagataactgagatacaatttcatagcgttcttgatcaatttttaaacgattgaccatttctttaagttcagagatatcagtaatgatactatttattactacttgaccgttttcatctgtaactttacgtccgctatccattacccataataaacttccgtctttttttcgaatccgatattctgttttgtattctggtccgatggcaaaacatcgtttacaatctgctaaagcagcaggtaaatcaggtggatagactgcgccaacagcagtaccatgactcatttccatgaattcatcataagtataaccaagcattttacagagctcttcattaacataaaagtaagtataaaattcatcatcaagactacctttcattcccccggcagttgttctgataatcatttcaatttgttcattttttttctttaaagcttgttgtaactctttatatccgagtttagcaatttcattggtatagaattcttcttgactaattgcatcattgggggtcgaggcatgaacatgaataattttaagtgtagtattaaattgttttaaaacaatcgttacccgttgatccatatcaaaaagggctcctttgctttcgatatgtaaatgataattacaataaacgattccaatattatcgtcgttgtagataacataacaatcttgaaaggtaatttcaggaacataaccctcgttacacccctctttaaagtattgatcaaattgtttaaggttgtttgccatagtattattactagcccctagccatgagccttctggagcaaacatattcttgacttgatcaaaatttctgctagtgaaatatgtattgataaatttttgagcagttagagttaaaaagtcgtctttgatcattgtttgcacccccttacgtttagtttaatagtaacacttattattagtaatgttaataagaagatttcaaataaaaaaagaattgtggtttactcagccacaattcttttgattttcgaaacgttttcaacaactttttaatttcacttttcatctacgcatcttctattactttgccttatattatcttgttgttttaacgtttctttaaaaggctcctgttctaattttttattattatgtttttttagaactcttccttttatctacttcaaatatatacctaaaaagatgatttttcaagcatctttcaaatgttgttgtttttatttatttttatataatttatagtataattaaatttaaggggtgaaaaaagtattgaatatatcaatgctttttttattgatggaatgatgcggttgaataagtcaattcaataaagtacaattaaggtattaaagggaggaagtcgatataatgaaaagattgagtaaaattttattagtatttttgatggttttaggtcttactgcgtgtagtggtgggagtaaagagaatgagccggcaaaaattgaaatggggaaagaaaataagtttgatgatttagtttcatataaaattgaaacgattagtagaccacagcaaattacccctgatgtaattggaagtttttatacatactataaaccatctaagtcaacaaatgtattaattgatgtgactatgtatataactaatctacaaaaaaaggaaatgaagctatctagtacgttgaagggaacatttgttattgataaaactgattatgtcgcttcaacagcaatggtaagtgaagatggaaaaacaattagtcaaggtggaagtttagctgctgaggggactaataaagtgcatttttatgccgaagttaaaccaagtttgttaaaaaataatatagaatttaagcttactactgttgatgaagaaaatcctaaagaagcgaatatgagttttaaattaacggatattgctaaaaattatgaaagcaagaatttaaatgatacgattgtattagatggtcgcggtgaaattgctttacaagcagtaaatattacaaaaaagctggagcctgctaatccggttggtttatatacttattatcaagttcaaaatgatggaaatagttttgttgttttgactacttcgataaaaaatatttcagaaagtgacatcacagcatctaatattgcagtagctaaattggttgataaagatagtaatgaatatccagcaaattcattttatgaaaaagatgatcgtagtaatttagctagtgccagcactactgtattgactccgggtcaaagtgggatgattcattttgtttttgaagttagtgatgctgttgcaaatggggagaaatcagttagaatcacatataatggaaaagtatttattgttaatctttaagatctagtattgctagatctttttttgtgaaaagtcacgcttttttgtgaagaatacctaagtatatggtctttgcacgattagctttgaaagtattgtgagaccttaaagcaagtgctaaagtaaagtcatagaaagaaggtatttgagatgaaaaaatataatgtagtaattgttggtggtggtagtcaccgaaatccagatttaatggccatgcttgcaagtaaaaaagatgtatttcctttaaagcgagtagttctatatgataatgaagctgaacggcaagaaatcatgggacaatatggtgaaattttaatgagggaatattatcctgaattggaagaatttatttacactactgatcctgatgttgcttttaaagatgtagattttgctttaatgcaaattagagcgggacgtttgccaatgcgtgaaaaggatgaaaaaatcccattagcacatggatgcgttggtcaggaaacatgtggggcaggtggttttgcctatggattacgcagtgtccctgcaattattgagttagttaaacaaattcgtaaacattctccagaagcatggattttaaattattcaaatccagcagcaattgtagcggaagcaacaaaacgaattttccctgatgattatcgtatcttaaacatttgtgatatgccaattgcaattatggatgcttatgcaaaattattaggatgtcaacgtaaagattttgaaccacgatattttggactaaaccattttggatggtttacacatttatatgataagaagacgggagcagatttaatgccttctgttcgggagcaactaatggctggagaaatttttaaaaaaggttcagaagatgaacatgttcgcgaaaaatcatgggtagatacttataattttatgtcaacaatggtcaaggattttcctgagtatttaccaaatacatatttaaaatattatttatatcctcgtcatgttgttgaagaatcagatcctaattacactcgtgcaaatgaagtaatggatggtaaagaaaaagatacttataatatgatgaaagaagtaattaaactaggcgctttaaagggaactaaatatgaattagatcctaatcgcggtgttcatgctacttacattgttgatttagcaacatcaatagctaataatacaaacgatattttcttaattattactaaaaatagaggatgtattccaaatttagatagtgagatgatggtagaagtagcttgtcgggttggggcaaatggtgttgaaccactagctatggatccagtagatactttctataaaggattattagaaaatcaatatgcatatgaaaaattaacagttgatggattcttagaatgtaataaattgaaattattacaggcgttagtattaaatcgtacagtagttgatacggatttagctaaagtgattctagatgaccttattgaagctaataaagcattttggcctgaattcaaataataacactcccttactatatctctttatttgaattttgttgtagtaatagcgaagtttttaacttcgctattttatcatttattgcaaaaaatttttttgttatacttaaataataaaggacggatgaaaagatgcaattaaacgaattagtaaatcttcattttgatgatttgaatgaaagtgatttatatatatggaattatattaataatcatcgtgaagtatgcacaaaaatcacaattgaagatttaggaaaaaaatgtaatgtttcaaggacaacgatattacgtttttctaaaaaaattgggttagagggatttgcagagctaaaatattacttgcgcaatgaacagacccttgccgatgtaggattaggcaagacagtaaatatttatgcattatttgaaaatcacgctaaaatgattagagaattacaaaatcgtgattacaatacctgttgtcgtatgattgatcatgctaaacgtatttttgtagtttctagtgggacgattcaaagatcagtggcaaaagaattgtcgcgccaatttttgaaattaggaattattatgacattagttaatggtgatagtgaaattaatatgttagcacgagcaatcactgcggatgatttattgattattatttctttgacgggagaaagtgaatcggtaattagaattgctaaggtggccaagacagtaggaagcaaaacaatctcgattactaggataaatgctaacagtttatctttgctggctgatgaaccaatttatatcttttttggtgattttcctattgttttcgaaacagcatatacttcaccaacaatgttttttgcattaacggaattattgtttgcaaattaccataactatcaacaaaaaaagttatttcaacaaggaaatcaaaattatgctgaataactaaaaaacctgcgcttagtggtacaatcttgtatttagagctgatgaaacttaattatttcattgcccctttgaaaagattgatcattgatgcggaggtttttatttacttgactctcgttctactaagacaacaggaacaattgtatcgatcgaaccaatgtcttttccttgaatcatattcaatagaacttcacagcccttttcagcaagcatctttggattcctttcaattgttgaaattgagggggtaggtaaccgtgaatataaagtattatcaaatccgattaatttgacttgttcgggaactttaagatttgctcgttttagtgcatacaaggctcctaaggcagctaaatcactagaagcaaaaataccatcaatcctgcgctgtgtttttaaaaagtctgttattaatatttcagcttcaatttggcttggttcttttccttgagtttgtaagatataatttttatcaagtggaataccgtaagtatctaaagcttttttatatcctaaataacgctcttttttctcataatcagcggtgaaactagaaataaaaacaatatctctacagccttttttgatcaaatgttcagtggctaaaaaagctgcatgaatatcatcactagaaattcgaggaatagttttattattttcaggatagcgatctatacatacaatgggaatgtcattataaatgatgtcttctgttaatttatttaaaccactgatacaaataatgccgtcgacacacttgcttgctaaacttttaaaataatctttttctttttgaacattatttgcactattacaaataaaaacagagtagttatgttttgctgaataattttcaatatgtaatgctagagtcgcaaaaaaatcattgctgatgtctggaacgattaaaccaatcgtctgtgatttcgattctctaagacttttggcattcatattagaaacatagccatatgatttagctaaagcattaattttttcttctgtttcttttgaatatccgcctttattatttaatactctggaaacagttgcaatgctaactccagaaattgcagcaatatctttaattgatagtttttttttatgattatccatgttatctccttgcttgttaagattatataaattatacatgaataggctatgaatgtaaatattagcaggttttattaatttttacgtaaacgtttacgtaaaaatgttgacatttacctatttgtatggtatttttaatctaggtaaacgtttacgtaaagtgatggcgccgttatttttttaccagttaggttaaacgtttacgcaaataaatgcaagaaaattgcatctaaactataagagaggaaaatagtagaatagagatcattctggctaaggaaagggtttatggattttaataagatggcagctcaaattattgagcatatcggtggtaaagcaaatattgcttctttaactcattgtgcaacacggttaagatttaaattaaaagatcaaggaaaagcttcaaaagacaaagttgttaaaattgagggagttattaatgtagtagagagcgggggacaattccaggttataatcggtaatgaggttgcccaagcttttgatgcaatcgaagcattgacagggatttcaggaaaagaaattgatgtagtggaaaaagatgatttaaaggtaaaaggaaaatttattgatcaagtaattgaattagttacaggaatttttactccaattttaccggcattgattggagccgggatgattagggctttattgatgtttgctactagcattttaggaatgtctgctgaaagtggtttatacattgttttaaatgaagtatataatgcagtatattcgtttttaccaatttatttagcttatacgtcagctaaaaaatttaaatgtaatccatatattgcagtagcaattagtttggctttagtgagtccaacgattcaaggattggttcaaggtgaaacagggatgaaaatgtttgggtttgatgtattattcccagctcaaggttatggttcttctgttgttccaattattgtaacaatatatttcatgtcaaaattagaaaaattgtgtactaaatatattcatgcagtagctcgaaatgttttaacgccattaattactttattgattacagtgccattaatgtttatgatcattggtccagtaacaagttatttacaatcatttatcggtgaaggctatacatggatctataatttaaatccaactatttgtggaattcttttaggtggattatggcaggtattagtagtttttggtttacattggggaattgttccacttggacaaataaatttagcaatgtatggaagaaatactatcaatgccgtgactggtccaagtaactgggcacaagcaggtgcagctttaggtgttgctttaaaatcaaaaaattcacaaattcgacaaaatgcaatgtcagcagcagtaactggattcttctcaattacagaaccggctatttacgggattaatttgaaatataaaaagcctttctatattgcagttggatgtgcagcagtttctggtgggattgctggatttgttaatgctgcagctttagcggggggaccagttggagttttatcattcccattattttttggtgaaggatttgtaggattttgtattgcaatggtatttgcatttgtcgcttcagctgttttgacttatctatttggatacgatcgcagtaatgattaagaaacatttaggggagaaaaaatatgaaaaaactattatgtccatcaatgatgtgtgctaattttggtaatcttgaaaatgaaataagaaaattagaggaaagtggaattgatatttttcaccttgatgtaatggatgggagttttgttccaaattttggaatgggactgcaagatattgaatatatttgcaaaacagcaaataaaccttgtgatgttcatctgatggtagtaaatcctggggcatatgtaaaaaaatttgcacaattaggggtaaagattatatatgtccatcctgaaagtgatgtgcatataactagaactttgcaaatgatcaaagatgctggagcgcaagctggaatcgtagtaaatcctgggacatcttatgaaagtgtaaaagaaacattatcgcttgtcgattatgtgatggtaatgagtgttaatccaggttttgctggtcaaaagtatttaaattttgttgatgataaatttaaacaattttgtgccaaaaaagaggaatttggctataaagtgatgattgatggggcatgttcgccggagcggattgctatgctgtcaagtattggggtagaaggttttatcttaggaacgagtgctttatttggtaaagagaagagttatcaagaaataattaaagaattgagaggactataaaatgagcgatgtaattagactaattagtgcttcaggcagtgattttgaaaaaatgacaccgatggaattgaaagaatcaatttttaaatcagaagggcgggtaatcatgggacagcatttattatttgctggtgaaggattagttagaggaataactaattctgaggtgatgtttgcttttggtgctgatatggttatgcttaatacaatggatttagataatatggaaaataataaaggacttcaaggattatcttaccaaaccttaaggcaacgttgtaaaaggccacttgggatttatttaggttgtcccaaagcgggatttgaagacggtggtaaaaaagctttatatcgccgtgaaggaatgctttgtacacctgaacatgttcaaaaatgtgttgacatgggagttgattttattgttttgggtggtaatcctggtagtggaacttcaattaatgacgtaattgcttgtactaaatggatcaaggaaaagtatggtgatcaattattcgtctttgctggaaaatgggaagatggtataaacgaaaaggtgctcggagatcctctggctaatcgagatgctaaagagataattaaagaattgattgatgcgggagctgattgtattgatttaccagccccaggaagtagagcaggcatcagtgtcacgatgattcgggaactagttgaatacattcatagttataaaccaggcactctggcaatgagctttttgaatagttcagttgaaggggctgacccagatacggtacgcttgattgcgttaaagatgaaagaaactggtgctgatattcatgctattggtgatggtggcttttcgggatgtacttcaccagaaaatattcaccaattgagtatttcaattaaagggcgaccttatacatattttagaatggcaagtgttaataaataggtgaaaataatgggattatttaataaatggaagaaaaaagtagaagttgaaccatatcgtattagtgcaccagtagctggaaaagtaattgatatcaaagatacaaatgatcaagtatttaatagtgaagcattgggaaaaggagtaggcatcatagcatcagagaaacaaataactgccccaatcggtggtcaaattgtaagtttttttcctacaaaacatgcggttggaattaagacggataaaggtgtagaattattgattcatgttggaattgatactgttgaattaaacggtaaacattttatctcaatgaagaaacaaggtgatacggttgtacgtggcgatattttactaaaggttgattttgatgcaattagagaagctggttacgatccaacagtcttgatggtagtgacaaatactgctcaatatgcacaaatcaaatgtaatttaggaaataaaagtaataatgatattattattgagatagaggagtagaaaatgaaaattggaattggaaatgatcatgttgcagttgaatataaaaatgtgatcagagagtatattgaagcaaaatatggctatgaagtaatcaattatggtactgataggacagtatataccttagaaaaacaaatttacgctgttctattggaattgcacacaatgggataattcaaaaatataatcgtaaagatagtgtgttaaatgatacacaactgtttataaaaaacataatttatgatttgattacaaatacaaaaagaggttattataaatcaaaaacatttaaaaaaattatggaaagtatgatagatggttctagattagttattctaaacggcatgggggaagtaataaaaattgggaaatggtatgaagaaaaaggactgtttttttctaatacaggttataaaacaagtaacaaaagtgggaaaattattaaaaataaattaaaattatttgataatgaattaaaatattttgataatgaagatagtggtttttatatagacgaagaagaaattgataagtgcgattttgaggtatttttagattcacttagacagttggaaataggtgaaagtgtatacgataaggattattttcaagaatacaatggaatgtatgggagatattatattgatgaagaagataaagaaatatatgaacttattgatgaaaaatacttatattctctcggcaattacaagactgaaactgaattttatagtacaaataatatttaaaaaaatggggacattttttaaaaatatacatgctataatgttattgtagagataaactctctatgatgaacaaaacttattttatcttaaaattaaataaaaaggcagtcaatgagattgtctttttttattgaaaaggaggaagtatatgatagaaattgataaaaaaattgttcaaattcaaaagaaaattgatgaagagaaagttacagtttcaaaatgcgaagagcagctgaagaaatcaaaaatcagtctatctaactttgaaaaggataaaaaggcactgctgaggctaaagaaaaaagcagatgattttaatagaaaaatcagcgaaagcctatcggaatatgactgaatttaatgtcttcgaacatttcaaaaaacaccctcataattggaaatgtatacgtatacgtatacgaaaaacgggttttttttgaaaagcaggataaggagaaatcacaagtgttttcgattaaaaatcgtatacactttactgtgatttcccgtgaacaactgagcaacgctcagttttttcgtaaaaaaccgtatacgtatacaacttgtgttgtgtatacgaaattgtatacggtttttaatattctaataggggtgaaaaaatggctaaaaaaattattacatatcgtattgataacgaggatgaaaagaagcttatgatgattgaagaaacatttaaacgcgaagctgatgaggagggaataatacttaatcgtacaatcagtatgagcaaaataataaatctagcttttgataaaatttttaacgatggaactagttccacccagtttgaacagtcgcttctaaaaaacattgaagagaagatcagtgacggttttgatatgatcaataacacgcttgttgagaaagacagacgttcaaatgatatggagctgacactgacagaactgattgaagatgttgaactgattttaaaactgctgccgtactctaaggagtaccgtaacccggataactcagacaagaccagagaaattttagaactggtacaaagcaaatcaatgttcagaaaatatactcagtcgaaagctaaaaaagtaatcgagttaaaaaagaataaatagtcaaaaaggagataagtataatggcagacaacaagaaaaagaaacgcacctatgagctggatgaagcaactatagtccagcttaatcagattgttgaggtaatgaaattacgtgaagaaacaggcagtgacggaaaaatgtattctttaaacattgctgtagctgaagcaattaattattactataatacagtagtaaactgtaatccaactttctttactaggattgcttcaagtataacttcatcgctgatgtacagatatttaaaaccgtttactgaaacagctaatcaaatgcttatcaatgatgtacgacaaaaaatttttaatgaagcacttgcagataaacttgatatagatctgcaggaaatagaggagcaggtagaacagactattaataatttaataagtgaggaaaattaatatgtcgaagctgtttaatatcagtaaaattagatttttcgagtatggaaaacctgctcctgaaggttccaggttcaaggggattttagacgaaacttcattagttggatattcacgatatacgggagatgagaagaaaaatgatagaaacagagaactcgcaactctacatgaaggaggataccttggctatgtaaacaaagatgaatacacatttaccagcgaaggagacggatggttgcgggatgaggataaaaaagaatttgaaaaaactttggcatctctatttaataaagatggtgatttgtggtgggaaactattatttctttttcaagtgaggaggctgcaatgcagtttggtcttgaagaagtggaagactataaaatgttaattgatcgatgtatgcctaaaatatgtagagcactaaaaataaatttgaacaatgtgctatggtgggctaatcggcatgttgatactacgcatccgcatgttcacctgaactggattgaaaaggataaatccagggacagaggaaaaatgaccgaggcagaacttagaagggttaaaaacattattgtaacagaactgcttcatattcgtgaagaatcccaagatattgatctcgaaattaaaaataaaattttcatacaaaaagacaaggcttatcatgaactgattaaagctgttggaaatggtgtactggaaaagaatataaatgaaatagctgatctacataatgttctgcctaaaacgggcaggctgagttataattcgtatgttatgaagccgtataaaaaagttgttgataagattattggaaaaatattaaatgattgtgagatacagaattacctcaatgaatatatgaatatgctgaaccgtatcaatgattaccagaatcagtttttcagcaaatcaggtgataacgatattgctaatataaaaaatgctgaaatggaaaaattatattcaagaatagggaatatgattttaaaagattacagggaaaaaagtagtagagaaattaaaagcagtgaaaaaggcgatatgtttaaattttctgattcggtcagaaataagaaatattacaatgactcttcgatggcaggaagtcagggtataggttatatttttacgataaataagaaactactggtaagccaagatgatgattttatttttgtaatgattccccgcacacattgtaaaaaatatatgtatcttgataagaaatgctatgaacagctgaataaaaatactggtaaatacgcgattgaaacaagcgaggtagctgtatatgatcagcatggaaaaatgattgaaaaaatttcagtagatgatttaatggactactgggatgataaaacgaaaattaatctgaaaaaacaaagcagagttaaggatggaacaagttccataacaagaggcagaaaacgatcaagtcagacgaatagtaaaatcaactgtgacactgtaaaacaaaaaaaagctgtcaatgattacgtaaaaaaagtgagacgctggatgaaattaagaaatgtatatgtatccggttcagaacagtataaagaattgcgggagtgggaacgtgctaatggtattagacagatttaaaatattagagctggattctttgttgacttgtcgagacatatcataaagataatatagactgctagacaaagcggtgcagtaaaatcttatgcttataaaatgatacttatttatcacaagtcactggagaaataaattaatgaaattggggacatttttttaagacatgcgtgatataatgttatcatagagataagtctaagaaatatggaacttattccatattgagaataaataaaaaagacagtcatggtgattgtcttttttattggagaggtaagtgatactttatattttatgctgttaataaggtaaaatagaaaaagatatagtaaattcacgattaaaataatgtatataaagatggaacttgttccatctcaaaatcaaatgtatagagacaatcgtaaagattgtcttttttgttggaggaaaactatgaaaaaatggttgaatattattattggcttttttatgtcattgtttactgtttattttgtggctataaattttatcaatgttgtttattttcataaaatagcatggacattaaattttggactgctgtttttcaatgatcagaaccttattttctgtatattatcattgatagtagtgattatctggagtgaaatagttttaaacaatctttttggtaaaaacagaaaacgatggctgactcgcgatgaaaaaagaagaacgtcgcatttggcaaaatttaaagaaataaagccaagtttgataagacttagttttgatgataacagtttggttgaaacacgccttgacagagcggaaattagaagaaataaaaaatacagatttttgcatgatgctgaaacgactttacagcagaatttaaaaaatcttcttaaaactaatatcccgccactcatacctgtactgtcaaaatataacaaaaaacatcctgttttgaaaaagtacagtataggtgatatgaaaacatataaaagagcagggttggttttttcaggaggtcataattatatgtatgtagatcctagtgatagtcatacactggtattgggaacttcaaactcaggtaaatcgtggtctttagttttggaaatgcttgaaggttgcagaatggctggagagagtgtagtagtaaatgaccccaaaggtgaactagcaaaatttatgaaaaagaaatttgaaagtgacggatatcaatgttacatactcaattttgttgatccagaatattcaaatgcatggaatccatttgagatggcaattcaggaatggattaaagcagaagagttgattagggagaaggttttaaaacaaataaaagattatgaacaggctgtagctaaatgtaaaatattaggtttacctgaacctaaacgtccaaaacctataaaagctgattattctaaagcagtagaactagtcatggatgtagcaaataccctctgtcttgaagctaatccaaaggatcctatctggactgaaacagctagggacatggttgctggagcagctatattcctaatggaacgtggtgaatttgagtttgttaattttacaaacataagaaacttaatttcggaagcttcaaaaatgatttctcctgatgatgctgaaaattatggtattagtatggctcgacaaacaaaactaatgaggctgtatcttgacaattataggagcagtgaggacgattcagtcaaactgcttgatggttatctaaaaagctctgacaacaccgaatcatcgttcttttcaaccttcataaataagattaatttggtaactcaaaacaaagctgtagaaagagtactggcgagcaatgaaattgatttgaaaagtttcggtgaaaaaaagacagctgtttttttaatagttcatgatgaaaagaagacatactatccaatttcaacaatgtttgtaaaacagatatacgaggcattgatcaagtctgcacgcaacgaggcaaatttaagattaaaagtgcctttgaatatgattcttgatgaatttggtaatatgccacctgtaaaggatatcgatgctatgctaactgcagcacgttcaagagggataagaataacaatgattatacaggattttcagcagttgtcgaaacagtatggaaaagaaattgcaactactataaaagggaacgtaatgaatactgtttatctattggctggcgcagatgatactcttgaagaaatatcgaaaagtgccggtactgaaaaagtttggaacaaggacaagaaactgtatgaagatgtcaggcttttttctaaagacagactaaaacattttgaaatgggtgaggcactgttcctttctcaaaggagacatccttattttacaaaactgcagccatacgatgcttataaattttataagggcggattagaatctaaatatgattatattgataaaccgccaataaaatattatggtctagcagatgatttttttaataaaggtattgaaaactggattacagaggatagtgaaacaaacgtaattggattataagaagggtggaacttgttccatcatataaaaaaacaggaggaataaaaatgattacaaacgaaaaaaaagagaatatgattaacgaggtggtaaagagactaggtataaaaaagacaaagatatacccatcaaaaacaaatcctatagtacctgatgattataattcattaaaaggacaaattgaagaaaataaaaaactaaaatttgaaggtttaaaacttgataatatcaggatagtaaaagataaagaagaaattattgctgaaaattgtacatttatagattttcagtttagagattttacatgtgagaaggtagttttcatcaactgcatgtttgttgacttctcattgataggaggtacatatccgaatattatttttattgcctgtcattttgaacgccttgatgtaagaaattcatgtgtatcctcattagtagatttaacaggaatgactatgattagatgttcttttggtgatggttgcagaataactggtgcaaatataagcacatctcgctggctggaaacagatataaatgatttagaaattgtacgagatttaaacagtccacaaaaatgtattatcaatgattattttggtgatgattttagggacaaaagcgaagtagaggcagatgttgctgaaactattaaaaatatcgatattaatttactggaaaaagagattattaggagcaaaatttatgaaaatgaagaagtagatataaggatgtttataaatacagatctgttcaattgcaaatttattaactgtatttttgtatcaaatgattttgaagaagcgggactgattaattatgaaatgagactttcaatcataaaaacacacttctataaatgtgtttttagttgttctttgaaaggaattttatttgacggctgtaaatttgaatatcctgaattcaaggggcaactaacatactctacatttgacacgtgtgaatttgttgattctacagtaacaggatctgcaatttttagtcatactaactttattgactgcaacttaagcaaccttggctcaattatatttggcgagtcacaaagagtagaagaattaaagatttgtcaaacagtagatactattaaaagtactgaagaaatggaagaggaagttgataaacttactaaagaaaaaaatgaagcatttgaggagagcagtagacttaaaaatgaaattatagctatgacagagagggtcgaagaatttgagaaacttcaaagcgagctaatgcaattgaaagaagaaaaaagcattatagtgaatgagcgagaaatgaaggaacaagaaataaatgatttaaatgaaatgatcaagaatctaaaatccttttatgatgaacagcttaacgaggtaaaaaagatgcagcggtcagctgatgaaaacaactctgttgctgaagaatacgatattttagttcagattattcagttaattaaggataaaacagaagtgttaaataaatttactagaccagcagaattaagtgatgaaaaagtaacttctttcttggcttcgcttgaggaaaaggaaagaatggatatatttacaaaagctgctctcgaaagaatggaaacagtaatgtcggatggaacaagttccatctacaaagaggatgatgattaatgcgggatattgaatattataaacagatggcatttgatcctcgtcaaatgcaggtaattagagatggattaaaagcaggatttgatgttgaatggtatgcaaatacatcctttgattatctgcagatggaagaaattttgcttgcattaaaagcgggtttggatgatgactcaatgaatatgctttgcgacccgagaatcccgtatgagtcaatgagacagatgagagaatcaatatttgatcagcttgggatttatgaaaaggcagcggaagaattaaaaagaaagaaactgattagatactttgttgtatctgtcagtgtatttgtcatagtaattatcggatcaataatttatattaatagacataccataagctattattttgaagatataaatttagaattgaaggatgatcacattaaattagggttatccgagccgtttgtcgctggaaattatattgataaatatgacaaggaattaaaattaactttaccaaaagaaaaaaagtttaatgagattggtacttataaggtgtcttataaattatcaaataaggtgaaaaccgttacgcgggaattaataattgatgtatatgatgatataaatccaactatagagctgaacagttcaattattgaagtagaatatggagcagtaattaatgaaaatagttatgttgtaaaagttcatgataatatcgatggtgatttatcaaaagaattaataattgataatgctgttgatacaagcaaagcaggtaattataccataaagtattgtgttaaagacaatgccggcaatgaagcaactgctgaaattacagtaatcgtcaaagaaaaacctgttcaggagataccggttaaagataacgaaaaaaataacgcagacagcggaaatacttcttcaaaaaaaagcagtgcaggaaaaaaagtttctaacgcaggcatttataacaggttttttgaaggctacagcattgattcttataattcagcctgtgattatgctgaaggattaaagagttctggaaaaatttcaggatatgaggtaaccccaacggggacaggggttcaggttacctgctattaggtgatcgagatggaacttattccatctttttatttttataaatgatacaaatatattttacttaaaaaaagtgatgcatccaatgcctgctgacactgctgatatttaaaaagtgtaggtctgcgaacactgatgaatcatcgatgaaaagcaaggtagtacaagtctccaccttgctttttatctcaattcatcacctgtagaaggtgaggcaggggaaagtaaaacagaaggaatgtgagagagcatatggttatgtgcgttagatattaaagagtattttagaggtcagtcagtaatagaggaggtaatttaaaaaatgattagggtattatcccttcccgtagcagtacctttattgattaaaaataataccagtcatttattattgatcccatggataaatatatgaatacgatgaaaataattgaacttatgaaagaaagaaatataacagtatataaattatcaaaaatgataaattatgatcgtacaaatctaaaaaaaatattaaatggagaaataaaagagccaacaatatctactgtaatagctattgcggatgcattagagataaacatagatgagatagtaatcagaaataagtaaaattaatttataaggaagaaacaatgatatgaaagaaatattaaaaattatttatatagcagtatgttcagcagtttgtctatatcctatatacagatgggtagaagatgcagtagatgatataagatgtagttacagaaattatagagactctatcaatcactctgacagaagtaaaaataaaattgtaagaatagtactttctataagagatttgtggaaagttatgtcaatttttgaatatggtcatgaatattttcttcctacaatactatttatattattttgcaaagctgttttactgcttgtttttattacacttgggtatagcctgtttttgttctaatagaaacgcattaagcaactttgaataagaaatcacatgaaggagaatgtatggaaaatgaaaaagggagataaagatagattaaatatatcgaaaaaagaaatccagcagaaaattatcaaccttgtaagtgatgcatgggaaaattcatatcatgccggggcttatctgaatcagctgccaaaaagaactgactgtgaatatgatcgtgaaattgtcgagtttatcatgggatttaaaagagcactacggatcaaaagcaggataatttatgcatgtaaaaccgaagaattaatcgaatattattaccggcatcagggacagtatgatttcaaaaatgagcttatgaaagataccgggaacagtatatagaataaaaacaaaagatggaacaagttccatcttggaaaacagggggtctatgaacattacataatcttcgctttttttaagcaaggtagtacaagtctccaccttgctttatgctcgattatgtacctgtagaaggtgagggaggtaaagattagacagaaaggtgaatgagatttatgttagtgttctttaaagttattagggttgctgtaaagttactctttgcactggtaataacgttatctgcagcattactggtcaaagtatttagtgaagggataagcgctgaaatattaatttctgcactggtaattattttttggatggctgctttatcgtctatttatttgtgggcggagtataagatttatattaggcactcaaaaaaataaaaacaagttataaaatttttagatggaactagttccatccgagtaagaaagaggtatgaaaaatgaaaacaattggaattattaatgaaaaaggtggagtaagcaaaacaactacaacagttaatctggcttatggattagcaaagaaaggttttaaagttcttgtgtgtgatcttgatcctcaggggaatacaactggaacgctgttaaaattaaatgatgaaattgattataaaactatcgaaaaaattaacaatgcctttaaaaatactgatggtggtattgaagcagcaacaaatattattgacgaatataccggggcagcagtatttgaaaaagatatcagtcatgttcttcttgatcatagagtgacaaaacaggctattataaatgttggagattatatcaaaagtaccgatgaaacttttaagaacatgtctattttaccatcaacctttaatctttcagaggtagatttgaagttgaaacagcagggaaggtttgttgaacagaaaatgaagatggcactggatcatgtaagaggagaatatgatgttgcaataatcgataattctccgtatacgaatgctttaacgtataacacattaaacgcctgttgtaatgaaggtgatctaataatcatcccagctaaagtagatagctacagtatggttggattatcaaagacagttcacatgatgttagactggctttctattatgccgctaggatttgattttaaaattcttctaaccatggttaaccgaaacaaaattgaaagaagcgttgttgaaatggttaagaacctttataaggaacgatgtttttctacaactattagacatcaggcaaaaccaataacagaagcttcattgagtaagagtgttcttttagcagtttcagaaagtccggtagcagaagactataaaacgcttgttaatgaactggtagaaaaggagtttaaataagatggaacaagttccatcttatatcgataaaattatgtgtaagtattcatttgataaaactgaaaccgaatatatcgaaaactgcttgttggaattatataaaacaaaaaagttaattggtgaagatataaaatattggataaagtcttttactgatgctgtacatgctaatagattttatattgatgtaatctgtgagcaagatctaacaaaatactatcacagatattatcgaacaaaaaagaatattagaccccattcaattatatatatcaattttggatacgggtatccaaaagagcttcgatacggacattttgcatatgtacataaagttgataatggaaaggcgctggtaataccgcttgtatccttaaaaaataatgaacgcaagttaagatacagtgaagaagagattgtcattgttaatcatggaatgctgacaccgtcactaatgaggtttgacgaaatgcgatggattgatcttcagcgtataaatgaaaatcacgatgtacctgaaaaaattcaaacaccacgaggagtgataataaaaaaattaagaaactatctggaattagaatatcgatgaaatattaaataattatgaggtgattggaaaatggaaagtaaatatcaagaagcgttagatagactttgtgaatgtaactgtgatctaattgtacatatccagatggaattttttataaagcttttagaagcgaggaatgtaataatgcaatgtctggtaatggatcaatatatttgatttcgcatgatacaccagaaaaaaatttaaataaagcaataaatgaattctataaattaaattacccagatccaacaagaattaacgatattgaagaattttatgaacgtatgaaacatgattataaaaatgctgaatattttgaaattatttttgattagtttaattgaaaatatgaaaaaagttaggaggtcatgaagtatgccaaaaattagagtatatgctaattacgagttcacaaatgatagtgataattgctatgataatggggaactttcaatgctgtatgaagtaccaaaatcgtggatgaaatggaatgaagaaaaacgacaagcctggctggaaaaaaacagcgataaaatagataaagcatttaatgatgctatggttgtttatcatgttagtgaactctatgatgaggctgaataaaaagaggaattgaaatgaataaaatcgagaaatttagaactgaactggaaaaatataaagaaaaatatgcattattaataaaagagcatattcaagatgaaattaacaaaattgattcagacattgaaataagcatatacagcaatgatatagatcgtatatatgtcacatataaagagtttaaatttgaattcacgtattattattcgatgctaagtcgggaatcgtcttttcgtggttatggaaaaaccaatactcatggttattcttatgccagatatacaagagaagaacagaaggaacgtgatagagcgtatggttatgtgcgttcgatattaaaaagtgttttagaagatagttaggaaaagtggtggaatgaaaatgtatgtaatcaaatatgacagggatatttatgcaggaacatataatgatatggatggatgttatctttatccaagtagctattttaatatgcaaaaaccaaaagtttttaaaacactaaaaggtgcagaaaagcatcttagtaatttaaaaaataaagttgtttttggaaaaaatgctgatgtatataattttaagattattgaatggtctgaaaatgatttagaatcacatttgatttctattggagttaaacctggtaaaaatgatgatccacaaaacagtaatactatttcaccagataaaaagttagagaagtattggaaaaaagtattcaaaccattgaaaaatgaagaaatagaaattacaaatatcacagtatccgataatgtatgtacaataaattatttgatgccttattgtacaagtagcgaagtatatatattccaagctgacatagataaagaaaaagcagctggtggattttgtaacacagtagaagaaaaagcaaatgaaatgattgttatgattagagagtgcagcaatataagaaatatatttaaaaaaatacaggtatgataaattaaatatgaaaaagaagtgtaacatttgcggacatatagggaggagtagaaaatgaaactgataatagctgaaaagccgtcagtaggacgtgatattgcgaaggtgttaggcgcattatctaacaacaatggctattgtgagggaagtggctatatctgtacatgggcatttggccaccttgttagtttatatgattgttctgattacaaggaagaatggaaaagctggaaaagtatacctgttataccaacgaaatttaaaattaaactaaacagcagcagtggcgtaaaagaacagatggaggttataaaaaaacttattaatagagatgatgttactactattgtttgtgcaacagatgcaggtcgggaaggagaacttatttttagacatatttataattatttgaggtgtaaaaagccaatagagaggctgtggattaattcaatggtagaggaagatataaaaaaaggttttgaaaatcttgaagacggtgactctgataaatatataaatttatatgaatgtgcctacgccagagaacaggcggactggttagttggtattaatatgacaagatgtttttctaatatgtacagtgcttatggagaaaaaccattgtcaattggacgtgttcagacacctaccttgaaaatgattgtagatcgagaaaaagaaatcagcagtttcgtaagaaattattactacaaagctcagatacattatgatgatatagtggctgaatatgatgttaaatttgaaaacagagatgaagctgaatcaattgtacaggctgtagatggaacatgttccatcattcagtctgtaaaaagggaaataaaaagaaaaaaagctcctatgttgtttgatataacattgctgcaaaaagaatgtaacaaacgtttaggattaaatgcgaaaaatacacttgatgtagcgcagtcactatatgagaagaaacttataacatatcctagaacggattctaaatttttgaatgcatcaatggaaatagaagctcgaaatttagcagagcagatatgtagtcaaagagatattaatgtaactattaatactaaagcagtaatagacgatacaaaagtgtctgatcatcatgcgattattccaactattaaagcattacatgtaaattcacttaacgagacagaaagagatgttcttgaaatgattatgctgaggtttatcgtatccatgtctccagcaatgctgtatgaacatgtaagtacatctataaaagccggagattatatttttaaggcaaatgctaatcgtactatcgaatcaggatggaccgctcttgattttgaagatagaacaaattccatcgatgctgagaagcaggataaaaatatcagattatttgaatataaagaaaatgatagctggcagcagattaaatccaatgtaaatagtattgaaacaaaaccaaaacagaggtttactgatgatacactgttgactgcaatggaaaatgcgagtcttaaagattttaaaaatattgacggcattgaaagagttggacttggtacgggtgctactcgtgcagctataattgaagtgctgttggatagagggtatattgaacgcagaaagaagagtattattccaactgagcgcggaatgaagttgatagacattgtacctaaagaaatttcagatgtttcaatgacagtcaggtgggaagaacagattgctgaaataaaaaaagggaagattaaatccaatgtattcgttaaacagatagaagattatgtttgtgaagttattaaaaattattataagccgaaagatactatttctagaaaagaggttaagaagtcaggaaacgtatgtccggaatgcggcggggcattagttataagacaagggaggttcggtacattcgaagggtgtgagaactatccagaatgtaaatatataaagaagaaagaaaaaactcagacaaacacagcgaaagctataggggcgtgtcctaaatgtggtggtatcctgataaaaagaaaaagtagttttggtagttttataggatgcacaaattatccaaaatgcaaatatataaagaaatgataaataaacacgaataaagattatagatatggaacttgttccatgaagaaaatcaaaaatggggacattttttgaaaaaagacatgctacaatgttatcatagggataacaatagtagacatggaacttgttccatgaatgaaatcataaaacgatttattttacttggagggaaattatgaataaactaaatttaaacttaggagaattattaaatacaaagagaaagaaaattattgcaggcagtgttgcaggattgttgctggttgctggtattggtactgcttatgccgttacaagaacatccaatacattggtattaaccaagaatcaaattgatgctgagttgggacaggtcgtttcaacagatgttgtggattaccttaattacaataaaatagattcaaaaacagctgagaagatcatcaaagatgctaaatcaacaaataacttcaaatatgttactgttgaaaataaagatgaaaatggcaatgtcatttcaaaagaacaaaaagaatatcctgaagttggtaaatataaaatcaatttcagttatgaaaatgataagaaatctgttgatgtaaaagtaagtgatactacaaaacctaaaatcactgctcctgatacaatcgatgtaattcagtttacagatttatctacattcaattttgctgaattattaaaagctgaagattacagtgatttaaaggactggcagattgatacttcaaaagttgatgttaatacattaggaacatatgatctaaaaatttctatcagcgatgttgaaaaaaataaagcggaaaaagaaatgaaaattaatattgtagaagctcctgttgtagctgaaggtgaagttgcagtaacagaaattgttactgatgaaaatggaaacaagaaaactgttgtaactaagaaatcgagcagtgaggtaagctctaaagataacgttacaactggaaagccggttgaaaacactgacaaagtacaaagcgggtcagaaggcagcacatccaagccgtctgctcctagcggatcaacaggtggaaatacaggaaataatggaggaaacagcaacagcggaagcacaggagataataagccgactcatacacacagctgggaagcggtgacgaaaacagtacaccacgaagcagaaacaaaaacagttcatcatgatgcagtaactaagacagaaacagtaacagttgttgataaagaagcgtgggatgagccaatttatgagtatagaacaatttgtaataagtgtggaaaagatattacagattctgttgactatcattatgcttttgaatgtgatggcagctattctaataaaaaagtacaagtaggaacaaaacatcatgatgcaattactcatcaggaggaaagaatagttgtcgtaaaacctgcatgggatgaaacagtaattgtaaagcctgcatgggacgaaaccgtaattaccggctataaatgcagctgcggtgctactaagtaaaattaaacaactaaaggcagtcgaaaggctgtcttttttctggagggagtgagaaataataaaggacaaatcgtgatgttgtcatagagattattgtagaaggtatggaacttgttccatcatattttattacaaaaaaatgggaacatttttctaaaataaacgtgatataatgatatcataggagttattttaggagacatggaatttgttccatcttaaaaatagatgatagaaggcaatcgaaagattgtcttttttgttggaggaaagcaatgaaaaaagtatatttatgggtattcgacacatgagcagtcttatgactgctcattattgtttgacggttgatcaattgcctgatcgtaataccgattttaaagaagtatagtgatgcttgcttattaaattaaatatagtatagaaataatctttaagctgtaacttgcatcacagaaaatatttttaacgaaaggaataggtgtaatgaaaaaaattagtacattcttattatctgtactggtgctttttggtattgttacaaatgacatgtcatttattaatgcaatgaatattgaaaaagttactctaacttctgaaaaagaagagctggagacaggtgaaaaaacaaatctaaatgttcgtgctgatttaccggaaactgctgaagtaattgattataagtggacaagcgacaatgaagaaattgctattgtttccggtgaaatgaacagtgcggttgtagaagcaaaagcagctggtaaagctaaaatcactgttactgtaaactacagaaacaaagtcagtgcagaggaaaatataaactcgtctactgccgaaattgaaattaatgtagttgaaaggaaaactcaggatatagttactgcaaaagaggaatctgatgctgaagcatctgaaaataatcttgatccagtaactgctgaactaattttagtatttgctgtattgtcttgaactgtcgctttatctcttaatgtattgcgaatagattttgttccatcttcattagttactgtttctgttacaagttcttgattttcatttggagcttctgttatattaactgttagttctttagtagtttcattactagaagtatccttagcagtaacttttaatacatatgttcctactgtgttactgttaactgcactgctgtcgtatcctacctctacaggcgatagatctgttgcactaaataaattaagacctgtaaaatcatatgttgctaaatctgttccttttacaatatctatatcacgaaattctgtatttagctctggacctgtagtatcaacaactttaacttttttaacaagtgtatcatcattaaagatcattgttatcttatactctccaactgctggataatctttaccgtcctcatatttaaaattagattttatacttaaaccattttttaatatttttttatcttcatcatccataccttctgtattcaataatttcatgccgttaacagaatatttatctccatattctaatttaatagttttactatcacttagaacgaaatcgggtaaattatcttttgttaaagcatatatacccagtgtactagctaagattactgcgaatacactaattcctgcgataatctttttatttcttgtatctaaataatttaataacatttttttcattgtgctttgtctccctgttttaccttttcaacatcctcactataggacttctctattccacataaatagtcaatcgatactttatatagcaaagcaagctgcattagcttatcgattggtggcactcggattcctaattcatataatgataatgtagatcgatttatgcctgttaactcttctacttcgaactgtgttaactttctttttatcctcaactgctttaagcgttctcctatttccataatgaatgttcctcccgtgcaaatcatataaaatctattgctactttaggtagcattgctacaaagagaaacaaaaatagtagtattaaaactaattcaattcaattgttctcatctgtattcctcctgatatttcctttacaatttaatgatatcaataaagaaaaaaggttagggcacaattttttttacgtatataactgcaataaaaaaagcagtcattggtcgaaatgccaataaatgctctcaatttttggatacaattttaactatactaattttaacatatcctttgtttcaaaaaggcacaattttttttcaaaaaagtgaatattttttgaataatattcacactatttaaaataaactgatttcatcagtgttttttcttttgttaaatcattatattagcaatgcaaatactcattttctactaaaaatatctactaaaaatatttcttgactataaaaaagaggcaatttgcctctttttttaagttattaataacaactttccattaaaacattatcaatccaagtcttatcgattgtttcatactgccgtatttttcacttcattcgaattattacaccaagtaatttatcccccccaacaattaaaatagttaaaactcttttcatttttattcttccccgattctattataatacaataaaaattaaccaaaaagaaagagcggtgagaactccactctttcttgtataaaggaaaaaaatacaggtaatcatgcaagcatcgcttttcgacagacagttttctaatccaaaagtatactattatttaattgtctacatttattacctgcaaacacatcttagcatatttgcatattagagagggcacaattttttttattttatcttacaaccatcacttacaaaaggcagtgtatcacatgcatcttgtacatttatacattgacatcaatacttggaacatattctttatcctgtataattaatacgatttcttcaatgttaataaaataacattaacttaaaaaaattgttataattattatttttatttagacacatataataaacagtgatgtaaaagtatcttactctctttgccttctctatctgtacacagtttctttcaggagctggaagaccatttatcattctttgaatttcttcacacaattatctatagcacaccactctatcttctttttccatcaaattttcctctttatcattcattgtgctgtttaatattatattcttattcaaccacctgctctttaaaatcattatttagatactcatagttttccatttccaacagtttctcaatttttttattaatggactcatctgctctttccttaacaaaatcaaaaaatgtataataactgtcttttaggtacgattcacaaaaattctttgcaactatcattcgatgaagttctgaaatagaaatttcaaattcattcaaaatttctgttaaattctctacccttctaagctgatgatcgcttacattcttaatctcttgataattttttttgaatttaagtaaaaactcttccgcttttctatcaccataattatctttatagtatttttctatcttttttgtcccgacttcaactgttaaaagtaaactttgtttgccgaaaattaattcatattcaaaatcctccaacaaaatatctatttcatttttcatttatttcaccaccgatctattaactgcttatagtaaatatattcacataaaaaatataatttttttctcacaaaagttcgagttcattatcattttctatttccttctctaacttatttatagcatttttctctatatattctttaacaatttcttttgaaagcttgtcacccctgcttactggaactaaaaagtatttgatcattttatcgacttgtactttaacaaattgactgccatcttcatcactttctattccacctaacaaatcaataagctccatgtatttatcataagatagaatattatctgatataaaagtatcttttttacattcattcaacataaaattgtcatcatagttattattaaaaataagaactaatctcttcgcctgctgtttataattatcaggtaaaaacatagagatttcatcatcattaagataatcattaatctcctggactatttcttttctttttttatatttagaaatattttctctgatatctttcatttcatgatgagtaattcctaatacgctttttaatacaactgctaatttgaaatactcactatttacgacattttccatttttacctccttctgtaaagtaaaaaagaggcaaaatgcctcttttttaaattatcatttccgtcacatcttcttctaaccatatttttttgtcattattctcacacagctctaaagattcataactgttttgtaaattatctgtattatttatttcagtgtatttttcttgacgatcccctacaatagaataatattcattctcacctatcacaatatgatcaaggacttctatttctaaaatgcgccctcccttgattaataaatttgtcacgtcaatatcctcctgacttggagtacagtcaccagaaggatggttgtgtataatcattaccctatttgctcctgatagtagagctgatttaaagacactttttggatcaactattcccatatttgcacttcctatcgagcatacatgagcattaataattttatttttactattcatatttaaggtcattaaaatttctcgatctaaaaactttaattcatttgctaaaacttcgacagcatccaacggtgttcttatactcttttcacataaaaactctctttccttaactaatctgattccaacaacatcaatactgttcatttgctctcttcaccttttttattccattttcatctataacaatctcctcatcgtcctttatattatctatcagttcctttaaaatactgtaactaatttttttcatcctgttctccttgttataattctctctcattttcatcttcttcagcatagttttcacgagagattaatgtatttttcatcaagttcctcgattaaatattcatgcttcatatttattagctccttctttataaaatagtactgtatgtaaaaaagaggcagtttgcctcttttttacataacttaatcataattccatatcttcatcctgttcattatcaacagtgatattaaaatctaaattcaaaagctgtttacatagatcagtgtatatgtcctgctcatttaaacaggtttccaacaggtacgtcctgtctctgtcatattcttttaatccacgtaaataatacggcttatccctatcaagaataataaaaggaacaatattattttttaaacattccttgaacatgattgcacgcccgacacgaccattgccatcaccaaacggatgaattctctcaaagcgtaaatggaagtcaacaatatcttccaaagttactttgcctagcctgttatactcttcaatgagtacgtctatatctctttcaacttcgtctggttttgaggttttaataacatttaccagtccaattacattgggatggattttaaatcctcctacattatatctgggatttgattcatcagaagttcccttttttagaattttattcatttcaataatcatatctttatttaacctatcatcaatatgatccaagatgaaatcaaagagtttaaaatgatttactgtttctgtaatatcatctactctgactacctcatcgtctttatcaggaaaaaaagaattagtttcaaatatcatttcagtctgttcttctgttaatcgacttccttctattttatttgaattatatgcaaacaatacctgtgaaacatgataaatgttaccaggaaattttgattgtttttgttctatgagttccttttttaatttttctatatctgtcatttccaatctcctatacttatgttataagtatatcactttaaacataaaatgtaacacaaattgattattcctgtaaaaaagacaaaatatatcttttcctacatctccatgttatcattgctttctctatcttctaattctaactgttcccttaaaattctattttcttcataataaacagttacacgtaaaaggtcgtttaaatccttaattttaagatttggttttccatcatagccgtatgtttttatttctagtgaaactgtattaccattatcgttgaacaccccttcattgtcataccatttctttatttttttactcgctatcacaccagcatcatctaaatctggcataatttctatttcttctaaattttttagagcaggattattctttaaattatatttaagtgtgttaagcatcgtacctactccgctgcacattaatacatgagcagttagattgtttctatttagagaaatatagctaagtccatcaattacgctttctgtaactacaattttttttattccttcaaaattctgataaaatagcccgttatttttaaatgaccctttacagtctatatgaaattttgaattgcccgtacctctgcggattgcaaaaactggttttttttcttttatattatttacatcatatccaacaaataccacattgtgatatatatcttcatatacaatgccatcctctattagtttgctaacaagtgaatcgcttagttttctttcattggtcagataatgaattgctctctcattattatcgtttttttgtgttaatacaagtccttggctgatatgactttcgtccatagaaaaatcatacaaatactgctcaatttcatttggatttcttgaataaaagtactctaaaagtatattaattgcatcatatgttgaagtattagtgtattcactgtaaaactcaattacatttaaaggtactgacccgcaacgagcattccagtacactttgttttttaaaatatcaaataccatcgaactatgttcaactggtttaagatatcgttgacttctactgcttttatgaacagtaagattaaaaacatttgttgcaacttctatacatgtaagctccttgagcatttcacttacgatagttttacggtattctttttcagaattgcttaatatttttacattagtcatttttattcactcctataaatataaaaagaggcaaattgcctctttttatataattccattttgttacatactttctttaataactttaactatattttctataattctctttcatctacaaattcatcttctgtatatctaaaatgcgtttcgaattcatcacttaaatatgattttcgaatttcatgattcaatgtttgaaggtgattaggataatgttcatatatatccagcaacatttccctattttctatgataagtgccttttcatctgaatttattcttaggttatcaataaaatcatacaaagcgctccatctatatccatgatggaatttttcagactcttctggatgttcaataataatccgctctatgccagttttattattcttttcaaaaaagctttcgaaacaatactgctcatctagagtaacaaataagcctaataaacatttaaaattatcatcatttaacagtttcttaaattcagtaccaatatttttttcctgcttcaaagacaatttaatattattctttttgagatactccttaaaataattatttattgcactatcaaaatcttcttgagatgcaagctttgtatatttatcttttcccaatttcacgtttataaattccatatttgctttgtttctgtaataatcgttgatccagtcgtgacatcctaattgttccatgatttttactggtaaaacaatttgagaattaatatatatttttatagggctaaaaattcttgacattaataaattattaggattttcaattgctagcgtaaccgcagtcgctccatctgttaaagccctataaatatggcagtatatatttttctctaataattctttatatgaatcataataactggtaaattcgcattcaccatactcatcataattgggtgatacaatagtatgaagctcaattttaaatttctgattgtccattgtttcttcaatccagcactctaagaaaatatcatgctttttaaacatactgctgttattcctgctgtagaaatcgtttgcgattttttttgcctccttttcggttaatatgtttgtcatttttttgaatttgaacatttcttttatttccttctttctttgttaaaatataaaaaagaggcaatttgcctcttttaagatttgctataacgcaattctcctttattgcataattttaactatactaatcttagcatatcctttgtttcaaaaaggcacaattttttttcgaaaaagtgaacattttttgaataatattcactttattttatttacctttttctgttcttttgtaagttttgccataacaaaactgactctttttaaatttctagttcgatttcctcagcttcattttcctctaatacaactccattgttattgtcagttaaaagattagtgatctctttttgtctttgtctcaaactaagcagttcttcctgtgattcaaattttttatttataatatcatcaagttttgcataattttctttcatgttattaatttgtataaaatacttttcataatctttttttatttcaaaaatttttctaatcattctcccaacattaactctgcctactgcgtttaacaatccagcattgtacagatagttattcgctcctttaaaacagatattccaaccatttccaacattataatcaagaataaattcaaaacccatcatttttccaataggaattgaatttttttctttattcatgtcagataatctgatgataaaatcaccatactcctttaaatcggtaaagactttgtctttatattcaactttaaaatcaatatccattttctcattaatcatttcatattcaaaattgatatgctttttaaatacagaatagtctttacttatacgatcgaatttcatttctaaattttttattttttcaggcatattgcgcttatcatcctgtgcctttctaattgcttttctgtgtcttgccagactggattcaagagtttttaagcgtgtgtctacttcaagtttttcttttattaaaggattaccgcttgcaatagctttgatttctgcatacgaaaaagttgcctttgtatcttcttcaatttctcttgcacagccactgccttcaagcagttgattcatatacgttgacttggtttctatcagttgccatgagtaggcatcgaatgatttttttgttgcatatctaaattcatatacttcattattcatatttccctgcctaaagacccgtccatttcgttgtgcaatatctgaggctctccatggtacgtcaacatgatgaattgcaatcattctttgctgaacgtttgtacctgcaccaagttttgctgttgaaccaatcagtactctgacttctcctctatttacatctttataaagtttttctttttttagagttgttttatagtcatgtataaatgcaatttcttcatcatttacacctaatttaattaaattgtttttgatttcgtcatatacattgaattgtgatttaggagtagaagaatcacaaaaaacgagttgagtagctttttgatccctgtactcatcatatattctatatatctgttctgaaattacagttaatttattatctggagtcaaaccgtagctttcgtcaataagacgcagatctattgatgccttcttgctgtcactggttacctttaacatattatcttcatatggagcaactgccgaattatgtattgcttcagttctttcgactacatttgcaatataatcctccaactctggacttggttctattgaaactacctttgccttatcgcccacatgttttggcggtatagccctttttctttgcagtttagaattttcaagtgcattattcagcatcgactctgtttgaatttctgcaacctctctaaatgaattcattaattcaggtatattaaaaaatttgttaaacctctgtctggtttgaaatccgcttccgtctactgatacctctagagaagtaacaactttaccaaatgtttttgcccaggcatcaaaattatgaatatttaatctttctaattcctcttcctgtaaatatctctgcattgtaaacagctcagccatagtatttgtaattggcgtacctgttgcaaagcagacattaccaccgcttttttgtataaatttgcatttcatatacatatcactggctttttgacttctagcttgaggaacacctgcgatatttgacatagcagtatacgtatataaattcttaaattcgtgtgcctcgtcaacaaacatataatctactcctaatttatcgaaagtgatcccctgatctcttttaatatctgtaagcttctttacatttttttctacggcctttttagaacgttcgagcaacttaacaacagcagtattttgatggcttccatttgcttttgcttcttcaattgcagttactaatttatctatttcttcattcaaaaaatttaactgtatctcattatccataggaatcagtttaaaagacgagtgacccattattactgcatcataattattcactgccatcttatttactatatctgctcttttctttgtgccaaaatcattagtagaaattgccaaaatatttgcctgtggatatagtgtcaaaaattcattacgccattgtccaatcaaatggttaggtacaacatacagcagtttatttcttttacccattcttttcatttccataccacttgcaatcatttcgaatgttttgccagctcccacctgttgtgataaaagagtatttttgccatagattattcttgcaatagcatttttttgatattcttccatctgaaaactgttattcatttcaggaaagcttaaaaattctccattataaattcttggccttataacattaaacagtcgattatactcatcttcaatctctctgcagtatttctcattgtcaaatacgaactcaacaaatgtattttccaactgtgacgacaattctcttgcctgtccagtcctttcgctgttaatttcactttttgtttttacgatgccaccttcatttatttcctcccaatagtttttcaacgttgggattttggaattcaaaacatcgttcagcaggtcaaagccattatatcttggctgtcttttaattacaccgtcagtatcaatattttcagataaaggtactccccattcatcttcaataaaactattcccaaagaatctatactcgtaataatccattgcaaactgtcctgtttcattaataaagcttattgtcagtgacttggaatcatacatcatattttcaaatcgaaaaaggtagcaggcgaaatcctcatatatgtgagttggtatatatggcgcacccaattgaaaagttatatcagtaatagtcaacggttcaggcataacgttattcaatacattgatatttttttcatatctgtcaattaaattattttctcttataaagtctattttttctagaatatttccagaaagatactcactttctaattgccacctttcttccttaggatcataaaataccatagccgatgtgtgcatttccttttcaatgctttcaatacttttatcataaataatgctcatataatttaaatctaacatacctttaaaatttaatgatgcagaaatagcatcctgtatactttcaacatgttttatttcaacaacgggattgatagttctgattttaaaaatatctgattttatatatgtatttgcctctacgcctttagattccagatttaaaataagatactgccgtggatctctttctaaaagattcttaatagctctggaattgatataattatgcttttttataaaactgtcatatgctatatttaatgaatttcttaaagcaagatatgccttctcattgaatttgttagatgactgtatactaactgtttcttcagcaagctctgcaattttaataagttcctttctgcgaagattatttaactcgttatcgtgtaccagtatgcagtaattttcatctctaatatatacattatcatctttcacaaaataagtattcagtttcagattaaatgattcattatcaatcgcaatagtatcagctacagtttcctgaacagcttcataatatatatttgaaggcaggactgccattgctctagcaaaatgttcatcaagagaaattccatcataattgactctcattacatgttgtccaaatctgcctatttcgtcctttggtgtaccaaatatcatatcaggattatcaataaaatatttattgatttttagttcagatgaaaaatattcagactgcatccagttttcaatcttattataaggctgtttattactgtttttttgcaaaataataacatcagtagtggttgtagtattagcaccattaatattaaatatattagtcggcagtcttaccgctccaataaaatctgctctcaaattaatgtactccagtatcctggatgaaccgtccatcgtatttgtcgatgttataaaacagataatccctccttctcttactttagataaagatttggcaaaaaaatagttatggatagcaaatccataactatttaaatttatgtcgtgtacctgataatttccaaaaggtacatttgaaatagccagatcataaaaattatcaggtacatttgcctcctcaaaacccgatatttcaacttttgcagacggataaagcatttgtgcaataccgcccgttatagtatcaagttcaacgccatgaatagaagattcattaagcatatcataaggcatcattccaataaaatttcctgtaccaagactcggctccaatatattacctttcttaaatcccaactggtctaatatttcatatatcttttcaacaattactaatggtgtataaaaactcgataatgttgaagcacgtgcattttgatattctttaattgttaacatctgtttcaaaatatttctttcggcagcatatttcatatcatcttcattgaaaatatgtggcaatccaccccagcctgaatatttagaaagaacttcctgctgttcaggtaaaatacttaaattactgctagactgtaaatttctaagtacttttatcgcatttatattgttattcagtttttcccttaaagataaatgttcatcatgttttacagttaatctaaaatctctgtttaaatgtaagttggtcgattcttgataagtggctgattcatcaaccattccatcatcttcttttgaaccatgtcctgtttcattttcgacaatgacagcttctgaatgaacgaaagttccagtggctctggatactccactgccactaattttttgatctgctgataagctatctctgaagctttcatcaagtcctcgatttctgtgttgattgtcttgtttattgtcaattctaaatacatttgcgggttcttttctttcaaaatattcatcatcctgtccttcgacatcccccatgaggtaatcatcaaatattgagatttgttcccattttctttcaccaatttgtccattttttcttcctcccatacttttttttggcatctattctttcctccattatatcatattcaaaaaaaagaggcatattgcctctttttaaacacacaaatcatatgtattggtttcttcatcaaattctgtataaatttctttttttgattctatcagcagttcctgtaattcaccttttacttctatatattctgaaatttcctcagcaccgtttagagcgctaaatataatttcaggatttttcttaatctgcttataccaaaattgtatatatgcagtatgattatctatcttttcctgctttatttctattccaatatcagcacataaaaaagatgaagctatctcagcatataactcttcaaatgcatatctttcattatttgtttttaaattaggatagcttcttcctaatcggttttctttcatcgttgaatgacagcactcgtgcaataccgctgatacaaactcgtattcatcatcaaaactacctttagctggaattaagatcatatcatttactggtttataaacaggacactcacataaaaaattttcaaaaatactaagattagcatttttgcaatatctatcaataaatctgcaagccaaatcatttacatcaatatgaatgtctttttcttctatcgtgtagggttctattccttcaataagtgaagcattaaaaacataaaatactttaaccgaccacttaaagcgttcatacttttcctgccgactgagattttcttctctgacaattttatctacatcgctaatatttaagtatttttttgtctccatatcatataaagaacatttttccaatggaacacccttgccctttgcattatttaatttataatttgctgctttaatttgtgaaaacgtcatccatcgtggatcgttataattattctttgcaacagcattataaagaataaggcgatttattcctctgtattgtgttttgataacaggattatagtttttgactgtagaccacccctgcttccatggtatgatttctttttccagtgattctatataagaatcaactaacgcctgccttgccttgctcatctctcttttcatgattactcatctccaaaatctagtggataaaataattcttctattacatcttcgtcacttacttctatctcttcatcgcatataaaaatttgtacttttttcatcttctttctcctataattccacttcattttcatcttggatttcatcattattcatctccaaaatttctgtcataaatatctcatcccaatactctaaaatgttttcatagcacttatccgaaatgtatttaaaatccatttgttttacaagttctacaaaagtaatcatagaacagtcaattggaatcatattactattctttgcagtataagcaattccatcctgactatcaattatttctggcgcatccacaatcaaaccatctttataacctctaaaatatgaatactccagtaacacttcagcttttctggaattaccgtattcatctgtatacaaatatggttcaaactcctttatttttgtttcacagtaatttttaaaaatatccattgctttgccagttttatattgatcactctcataatataattcactaacaatttgctctactgtaggactatcaataacaacatgccaatcatctttaataacttcaatttgattttcaatcgttttttttgcatgttcatacccataacattctaaaatacatgtttcagtgttctttgaatttcttaatttaacataaataatctcatgattttctttcttcatttcttcttctccttttctattttctttatccagtaaaaaagaggcaatttgcctcttttcaaaatacaaataatactttaataatttatagattgatttcattttcattgtcatcaaaaatttttctttgttttcagattttccaaaaccaggtactgaatgtacttttgaataaataaagccttcgagtatttccttctccaaaacgatgaacttgccatatatttgatgtaaatatagccaaaataacatgttagaaataattaattaagtattttagtttattgtgaattataaaaaccgctctaattcatctaaagcaatttcctgattaattctttcaacctcagtctcattctttaaatattgtttctggttttctaaacgttctattacctcgtcaatataattatctagttcagcaggtgtaatcggttttatatatccaaaagcctttaaggaaagttcatcactatttggtgtagaaatttctattgaatccattagagcttgtgcaattacatatccattagcacctttttgacataaaacttttattctgtcaggatctataattcccatattttggatcagtgacatagaatcaggatgttctcctataacaactaataacatcttcattctttgtctaatattaaaatgataagtattattttttaaatctcttagaaattcaaccgcactggtataatccataaaaattcaactccttttatatttctctatcatcatcaatatctttatccaaatgcaaatcttcatttgaaatagcttgttcagcgacaataagattttgtagtattgtaaaattatttttcagctcatcaatagttccagaaaataatatattttcaggataatcatcattctctataaaaattgatatttcatttgtatttgaattttgtataattgaaacatcatcggctattgttgacatataatttatagttggcaagggcaattgttttaaacagtcgactactaaatcaaatggtagggaatatgcataaatttctgataaaaacgatttacaaaatatcatgtattcttctaacatattcaattcgtccaaactttctttaattgtatctagataagctgtatctttatcaatgatttcaaaactaataatatcatcatcactataaatagatagaattcggtttaaatcaaaattatttctatgaataatttgagcaatatcattctttttacctgcgatggtattgttattaatgtaataaactttatctgctatctgataattatcagcaaaatgactttttaaaaaattagaaacaaagtaattttcatgtttaattatagtctccatactatgtttattacttcctagagaagtaatacaaatttcatgattattactattctcatatctataccaaggccagtttcctgcaccaattccataaacgtggattttggtattatcatctaaaacaatatctgctgcactatattctgtagtatcaacatattcattatctatccatgtaacagaaaaagtatcattaatttcattgtatttaaattctaattcatcaaatatttcattcatttgttctactacattttttgtaaagtaaggtattacatatcctttgaaagtgaaattttttaaagaatatccttcaaagcaaaaattatcatcatcaactgcaaaaaatccttttttagctttttcttgtatcatttttacaactccttaattttgttttaaaaagaggtatttcgcctcttttttgcatttacatacagtgtcatcattcttattttatcattaaatttcaggacccatatcatctgcctgttcctgctcattttgtttcagcgaatattcattaaaaacattttgcagatcttctttgctgtaatctatattttcaaaaaaatctattacagttttaccaaattctctatccatttgcatttcatctttaatcttcttaagcataaattcattagcatcatctttctgcatataatcaattgcatctaatgttaaatgatttactttcatgttttcaataaagaattctagtaaatcagcattatcaataatcattgtttttgtttgactgcgctcaatatcccttattctctcttttacaacttctaaagcatcatgaaatgtaagaccataatcaccattatttatactgttagttgaggtattaaaagtatgccaaacagtgtaactatcatcattttcattatatgccattacctgatataaataataatcatcaggatgattagataattttgcaatcatcgctactttataattttctaggctttcccgcttaaaataattatttactttctcactaacatccgaactaatattcaggtaatcctgcatttttatttgtgctgtaagaatatcaactgatctcaatttatccctattaccttccaataatacattaataatatcttcatcaatatttgtcagtttactcaattcatttattgcattcaagcgaatatcttcaagtttctttgcacttgtgtcatattcaagatcagcttgaggtccactaaataaaccatttagtgttttataacctgctttcatctcgtttaattcggcattttctaaatcatccaataactcatcaattcgttttattttttctctatatagcatttttatcttctcctgttataaaaagaggcaaattgcctctttatttaagttttttaattatatacttttagaacatttcaaaatcatcaacttctttttccatagtttgatttacattatataaattttgtacctcatcatttaacatttttttgcatctaaatttttctcctagttatagtcctaaatcataatcattttccaattctccatattcagtaatgtcaacatcaggagagtgatttccaataggattaatattaattatcattgcttctgtatttaattgctcttctatatttttttcattaaattaaaattttcttttgctaaatttcttttttcttgtgagatatattgattccacctgctttccttaataatttcttaaaattaaagacaaaaaagaggttctgcctctttgcataattttaactatactaattttagcataacctttgtttcaaaaaggcacaattttttttcaaaaaagtgaacattttttgaatattattcaactcttttactttacattaaaacaacagcacatatattagccgtaggcataaggaatgtcttgagacatgcgctctgagagcagggctatgcccgcaaatgtaaaaccaccggctaagccggtggatatttattactttaaagttgctaaaatcgtaaatatattagggtgtaaaggaatactttcagttaataaaaagatgattgtataacattaataattgtattatgaattgaagcatattcatcagtcatttttatgtttgtttatctttttgctttaattatttgtaaacagatttgttctgcttttaatttaattaatcaaggttagtttgaagtgataatagagtagtatttttaatgaaatatagaaaaattagaagctatttacataaaggtttctttttttcgttaatattgagttaatattagtttggtagatttttttatgttttgaaaatagaaatatattagatattgtcaaaaaaattcgaaacttttaaaaatacattttttggttgtttttaacaataaattaatatatagtagttacgtagattaaattttaaggaggactaaaatgagtgaagtaattgccattgaaggtggacacaaattgaatggaactgtggtggtaagcggtgcaaaaaatgcaacggtagctctaattcctgcgattgtcttagcagatagtcctgtaacagtatatggggtaccaaatatttctgatgtcgatgcactaggagtattgttaagagaattaaactgtgaagtagataaaaatgatgatgtgttagtggttgatccttctaacttaaaaaatatacctttagtaagtgatgcagttgataaattaagagcatcttattatttaatgggagctttattaggaaaatgcaaaaaagtgacgatgaagatgcctggtgggtgttttttaggaccacgaccaatcgatttacatattaaaggatttgaagcattaggtgcaaaagttagttatagtgataatggaacctatacgattgaagctgatcgtttagttgggaataaaatttatttggattttgcttcagtaggagcaacaatcaatatcctgttggcagcggttaaagcagaaggaaaaacaacaatagaaaattctgcaaaggaacctgaaattattgatgttgttaatttacttacgaaaatgggagctaagattcgtggggctggaacagatacgatcacaattgaaggtgtagaaactctttgtggttgtgatcatgaaattattcctgaccgaattgaagctgggacatttttagtgatggctgcagcggcaggagaaaaagtaattattcaaaatgttatacctcaacatttagaagcagtaacttctaaactaaaagaaatcggggttaaaatggatattgttggtgacagtattattgttcatggcggccttgataatttaaaaccaattgatattaggacacaggtatatcctggttttgcaaccgatttacaacaaccgctaacagcgttattaactcaatgtcagggagcttcacaagtagttgaaacgatttatcctgaacgctttggacattgttatcagctgaattcaatgggagcaaaaattgatcaagaagaagcaatgtgttatattaatggtcctacgccattacatggagcacgtgtttatgcgacagatctacgttgtggtgcagcgttgatcgtggcagctttaatggctgatggtgttactgaaattggaaatgtttatcatattgatcgcggctatgaaaatattgatcataagttaatttcacttggagctgtgattactagacgtcaagtcgaagattagtgattaatttaaaaaaatgacttgaaatctagatattttaatgttattatactaaagcaacttactttgtagctatatgctataaggcggaaggagattgatatttatgaaaaaaggaattcatccagattacaaaaaagtaaaaatcgtttgtacttcttgtggaaacgaatttgaaggtggatcagttttagacgaagtacgtgttgatacttgttcaaactgtcatccattctatactggtaaacaaagatttgctagtgctgatggacgtgttgataaattcaataaaaaatacggacttaaataattacacaagtaaaggagcgcaagctccttttttgttcctgcaaaaaagacttatgaagattcataagtcttaaaattctaaatgtctacgggttcgcttcattaaaataaaagaagtcactgcagagaaaatttccgcaatcgggaaacatagccaaattaagtctaagttacctgttaatgataatacataagcacaaggtaataatactaataattgtctgatcaacgaagttaaaagactatatgtacctttaccaacagcttggaaagttgcactacaaacaattgagaaacctgcaaaaatgaaatgaatagcaattattcttaaagccggtgttccaatttttatcattgcctcagaggcgttaaagaaacctaaaagagtttgcggaattgtttcaaagaagataacaccaatgatcatcatgccagtagcgtagatcattgccaattttattgtatcaaacattcgtttcttttgtttagccccaagattataggcaatgattggaatcataccgttattaagaccgaaaacaggcataaagacaaagctttgtaatttgaagtatacaccaaaaaccgcagtagccgtggtagaaaaagtaattaagatagtattcataccaaaagtcatgacactaccgatagactgcatgatgatagatgggattcctactgaatatatttgcttaacaatatgagcattaggtcgaaaccttttaaatttaaaatgaatatcatgattaaatttaagattgaaaaatagagctaaaagacaagcaatgatttgaccggttattgtcgcaagtgcagcaccagcgacacccattttaggaaagccacataaaccaaaaataaaaatagggtctaaaattatattgattatggcacctaatccctgagtaaccatagtaaacagggttcttccagttgcctgtaataatcgttcaaatagaaattgacaaaacaatccaattgaacagccaactacgatcattgaatattgggtaccggcattaacaatttcagtattagttgtttgaacattaaaaaagaggttagacaatgttagtccggcgatcataaatataaccgccgtgacaagaaaaataaatactgaattgactgctgtctggttaacatgatcttgattcttctcacctaaactacgtgacaataaagcattgacgccaactgcagttcccccggcaaaggcaatcatcaagttttgcaatggaaatgctaaagaaacagcagttaaagcgttttcgcttatttgggcaacaaagacactatcaacgatattatacattgcttgaactaacattgagataatcattggtagagacattgaaattagcagtttgttgaccggcattgttcccatcttattttcttggatcactatttttctccttttaaaaacaaatcagcaatgatcgttgcgacttcgtcgattcctaaatcactgttaatcgttaaatcgaaattttttaaatgaccccatttttttgttgtatagtaattgtaataattactccgacctttgtctcttttagtaacgtattttttataatcatcatgtacttcttgataatcctctttaactcggcgaattcgtgattctagtggtgcatgaataaaaatagataaaacatcatcataatcctcaaggatataatcagcacatccattaacaatgatacatgaatcatgattagctaaatgacgaatgattttagactgcattacaaaaacctgatcatttagtggtaatgaaaaagcggaagatgacattgtatacataaagctagatgatttttgttcagctactttacggattgcatcaacatccattcccatttcgcgagctgccaagtcgatgacttcattatcatagtatacaagtccgactttctgcgcaactttttgtgcaattaagcgtccgccagaaccgtattctctggcaatagtaataattctaggcatattgaaaatccccctttatattcttattttaccataaaatttaaaattaatgacaatattttcacatcctgctttttccaagacaaatttattgtttttgtgcatacaagtttgtataataaaacaataaaaggagaagacaatggaatttcatattttagcaagtggttcaaaaggaaacagtacctttatttatgataatggtgtgggaatattgattgattgtgggattgctagaaaacaattattatataaacttggcaatcttggttttcaagaaagtaatattaattatgttttattaacacacgatcattatgaccataataaaaatattagtatatttgatcaaagaatctgtttttgtggtaaaggatgtatcaaaggaatcgatagcagccatgaaatcaagccatataaaagttttcaattagctcattttgaaatcatgcctttaagtatatctcatgatgcgacaagtccgctggcttttatcattactggtgtgaatgaatctattttgtatatgacagatactggttatgtatctcaaaaaaatcggaaatatcttaataatctagactattatattattgaaagtaatcatgatgttgagatgctgatggcaacgaaacgaccttattttttaaaacagcgtattcatggtgatctaggccatttaaacaatgaatatagtgcaaagatgatggtagagttaatcggtgataaaactaaagaaattgttttagcgcatttgagtgaggaagctaatactaaagagaaggcattagaaacctatcgtaagatttttaatcaaaataatctagagttcgataatattaaagtagctaaccaaattgatgtggtcagcggaggtaattatgaagattaaaatagtttgtgttgggcgtttaaaagaaaaatatttagtggcaggaatgcaggaatatttaaagagattgcaggcctattgcaaagtagaagtttatgaagtagcagatgaaagtataccggataactgctcactggccaatgaaacattaattaaagctaaagaagggcgtaagatgcttgataaaattaagcaggatgattatgttattttgctagatgtgtcgggaacgcaaatagattctgttgaattatcaaataagatggaaaaagccatgatttctggtaaaagtacgattgcatttgtaattggtggttcacttggtcatggtgaagaaatgcttgatcgtgctaattttaggctaagtttttctaagatgactttaccgcatcaattgatgaggctagtcttagtagaacaaatctatcgggcatttaaaattatgaaaaacgaaacatatcataaataaggtattaataaaaaagaatatagatgaaaaaacctaatatttaaattaggttttttagtttctttttatttgatctttatattgacttaaactttcattagtgttcattataaaaactaaatccatttttacctgaatattttgaattatacagagcttgatccgcatttttatatagaacttcaaaagttgccccgtctataggtgctacagcaactccaatagaaccagttattagaattgtttcttcatgccattgataagataatcgtaattttttaagcaggttatttaatgatatgatggcattttctttttgaacaatatttttcataaatacaataaattcatcaccacccaaacgagcaattatatctgtttttcgaaaattttcttttaatatattagctacctgctttaatacttcatcaccttgtaaatgccctaaactatcattgattttcttaaaattatctaagtcaatgataataaaagcactcatttgattatttgatttatgaagatattctactattaaacgctgagcaccaatccggttatagatacctgtaagggcatctgtatcagctgcttttttaatagcttttagcttgttttcttgatttttttgtttaagatattcttttgtaatgtcacttcttcgaataagtacgattttattttcttcatcataatattgaacagtaattaattttctccgatattctttattttcatctaacatacctagttcaattttataaacactttgttcttgcagacgattaagtatatattcaggagtcaattgttcgataactctgtcttgatcttctaaaacggtattttgtcgtgtgtattttatcattgcttgagtataattattgccttcttgaggaggaatgacagtaccgttatcagttatcgaaaaattagaaaaatagccattttttgtatcaagataatacaaataatccccttttttataaacaaatttttctgtaattgaattaatgatatgttctctatcgacattactaaatacaagatatattttttcattgttcttgggaagatagagagtttttaattggacccattcataattttctagttccttttggaaacgtaggtcaagatgtgatgttttttgtgttttagaaagtaatcttaaattatcaattgttaaaaagttttctaattcttttttttcaaagttgataattaatcttttttcaagtagcaaaagaaattgttttagtgaaaatattttttgatcatgatcattattggtaggtaaaacagattttaatatatgtaatttttcagtagctaagtccacttcaacaattgtagaatatagattaaaaaaagcatctaatatttcttctttttcttttactaaagaggaaatagtttttctatcagaaatatcataaatataaaataataattttttaattcccattacttgggcacaaaatattctagcttctacccaagtataatctccaaaaattgtttttgttttaaactcaatttgttttaacttttttttattgattatttgttctagagatgcagatacaaaaatattatctaaacgtgtaatatcgtttgggtgtgtccattttcttataacagaaaaaacattatccccatcatcaattttatgatattttttctttttataaaaaatagtctttatttctaaactatctatatcaatttcaaaaaggccttcacaattttcgataaagtaaggtgaatataatcgtaattttttgaaatcgattattttgtgctcattatttttgatatccatctcaagttcttctgttatatcatgataatagcctttaaatcttattccatttttatatgatttatcaagaaaaccgccacaccgaacccatgtccaccctttttcttcatgtctccatggataccgtatttcggttcttttgttcttttttatattttcgattgcatcaaaaactaatcctatatattcagaatcaattctctccatacaaaatgaatagagttcttccggtgtcagagtattgctgtttcctcctaataacgagtacataattgtatcaccgtacatctttggaattccgtcgttaggatattctattatccaaaaaccgatttgcaaatctgctaataattcggttttattaacaatatctgatacatcttctcttatattcaaattttccattatttaaaacctccccaatataaatttgtatcaaataatttgcatattttttatcatttttcagttaaccattatacaatatcaatttcttttatgaaaggctcttttagttatatcagttgataaaatgataaaaaagatttcaattttaaaccattatatcaaataaaaataattttttatttaccatgtttgtacgacttcacctattggattaagtagaaaatataattataaaataaaaatgatagtttactttaatagcaagctgtaggcttatgaataatcatgatatgataaatttggaagtaagattaattgtaatagagtttttaattatgattgatatagatggatattttacaattagcgatggaataaataggggatagggagacttttttgaaaaatatttttttgtacgtataaataatagacataaatttttttgataaggtaaaataaatgtgattgagggaagaaaatcttttaaaatatgtgtaaaaaggagttgacagtcatgttcaaaactgcgatcctgccagacagtaggatagtgtctgctttttttgcatatatcattacttgttgcaaccggaattctaattactatatttgttgtattaaagaaaaagaaaggattaaaaattcttagtttataaatataaatcagcattctgcagggggataatatgctaaaatgtatatagattcaaatagaaaagttatttttagttgctatttcttttggtatgcataagcatgaaactggcaataatattaattatattgtatcagggatgggtaaagccatatgtgatgatgacgaagaaagtttatttgcaggaatctgccatatttgtaaagaagattctaaacatagcattattaacattggaacagaggattttgccatgattacgatcgttgttgagcaataggtgctgattttataatttaagacgatatcaagcgattagtcgttaagattaatcgcttttttgtatataaatacatgattgatagacgaaatctgacgggagaatagatagttttattgatttataaaatttattatataaatcaataagttaagatttcaatgaatgacattttaaataaacctttttgttcataattgtactaatgataatttggcagtataataagtaaaaatataagagataaggaaaaattatgaaatatataataagactggtatcagcaacaatagtttttgtgttggcaaataggttgttattaggtttttcaaacgtattgttaattggtttattagtggggatttttatagttattaatgcaataccatatgtcccttatcctagacctcttttgaaacgatatcgcatatgtaaagcagggtgtgaattattaaaaatatttttaatatctttaataatgacaattgtttatatgctttattcattttttaaagtagatattggcgcatggttaactaatctattagtggtaataatagttgaggctgttgttttttggaatggcattattagaatttatttaacggctaaccaattaggagctaaatggcgcataatcggggttgtttggggatggtttccacttgttaatttgattattttaagaaagcttattaaaattgctgatgatgaaattatatttgaaaatgaaaaaactattttaaatggagttagaaaagaacaacagctgtgtaaaacaaaatatccattgctgttggttcatggagtgttttttagagattttaaatattttaattattggggacgaattcccgaggaactagaacaaaatggagcggtcatttattatggtaatcatcagtcagcagctagtgttattgctagtggcgatgagttagcaaagcgaatcaaagaaattgtacaggaaagcgggtgtgaaaagttaaatattattgcacattctaaaggtggtttagattgtcgttatgcgattgcaaagctgaatattgcgccatatgtggcatcacttactacgatcaatactccacatcgaggatgcatatttgcagattatttattggaaaaaatccctgaaaaaattaaacaaaaagtggctcagggatataatacagcccttaagaaatttggggacgagaatccagattttattgctgcggtcaatgatttaactgcttcaacgtgtcaaaagttcaatgcggatgttcctgatgtggcagaagtattttatcaaagtgttggttcgaaactaaatgttgcttcaggaggtcgctttccgcttaatttttcgcatcatttagtgaagtattttgatgggcctaatgatggattagtggctgaaaactcatttccttggggttgtgattatacttttttaacaacaaatacgaaaagaggaatatcgcatggtgatatgatagatttaaatcgtgagaatattgctgagtttgatgttcgggaattttatgttcaattagttaatatgctcaaagtacatggttattagtctggagacacgatagttgctctggaagtcaaaatcatgatatgataagaaaggatgaaggagggttatttatggaagtcgctttagtaatagggatgtttgtttgtacagctttagcccttaattttttggttaatggaagacggaaattatcagggacttttgagataattaatttatgtttgattgtagcaacagcttatcaatttaaattagttagttcaattatttgggttcttgtaattttagcaatcttactgattgcaggattgatctttaataaaaaaagaaaagataaaaaagttgctaatgaaataattgaagcaagaatagtagataaaggagaatagaatggaaacagtaaatattattattgaaatggaagatggcggagtgatgaaaggtgagttatatcctgaaattgctccaattagtgtggaaaactttttaaaattaattgatcaagatttttttgcagggttaatattccatcgtgttatcccaggatttatgattcaaggtggaggatatgataaagatttcaaccatcatgaggctgacagtattaaaggtgaatttagaagtaatggagtagctaatgatttattacatactcgtggtgtattatcaatggctagaacaatggttcctgattcagcatcatcacaattttttatcatgcatgctgatgctcctcatcttgatggtgactatgcggcttttgggaaaatcacggaaggattagaggttgttgatcaaattgctaatgctcctagaaatatacaagattgccctaatcagccaatcgtaattaaaactattaaaagaggataaggaaatgaaattatttattttagaaaattgtcctcattgtcgtaatgcacggcgctggattaaagaattgcaagatgaaaacccagaatataatcaaattgaaattgaattgattgatgagcaaatcaatagtgaattagcagatcagtatgattattattatgttccagctttgtttgatgggaatactaagttacatgaaggtgttgccagcaaagatggtttgaaaaaaatatttgatcaatatttaggacattagtttgtcctttttattttaaatttaatatagtgtatgagtaatcaaagaatcttattactatttgatgttttattgtaatatagacaaaaagcctcgctcaagaggctaagagatttttaataatttgaccaagtattttaataccttgatcaattgtttttagatcacaattagtataatttaatcgtagagttgaaacgtttcgttcttcttcatagaaaggatcaccagcagcaattgcgatgtcatgtttgattgcttcatttgctagagcgacagcagttagtttttggggtaatgtgacccataagaacattccgccttggggaattgtatgtttaacttcagcagggaaatacttttgaatactagttatcatttgttccgcttgttctttataaagtttttttattttttcaaggtgttgttcaagactgttatcacaaagatattgatgaaggaccatttgcccaaaaatattagtatgaagatcaacgatttgtttataggctaagagcttttgctttaaataagagtttgaacaagcaatccagcctattctcatacctggagaaactgtttttgagaaagttccgagcagtatcgtttgatcttttagcaagggataaataggtaaaaatgtttcatcgttaaaacgaagatcaccataagggttgtcctcaataaagatagtgttagtttttttaagcaaatttgctagagcaattcgggtttcattgtcataagttaaaccagtagggttttgaaaagtcgggatagcataaaagaattttggtttttgttcaagatatgctgttaattcctgtaggtcaattccgtgatgatttaaagtaaccgagttgatttttggattatagagatgaaatacttggagtgcagctaggtaactaggtttttcaataagaattttatcaccttcatcgatcagtactgccgataaaatatcgagtgcttgttgggaaccgttagtgataataatatcattggcactaatatcaattccttgtttcaaatattgatgtgcaataaattgacgtaagggtaaatatccttctggaatactatactgcatagcgattgtaccatgctgatcaagtactttttgtgtggctgctgccatttcctgagtgggaaaagagatgggattaggtaatccaccggcgaaagaaatcaaattaggcttgttagtcgcttgtagcatcatgtctaaaaaatctccttgaaaatcgggtcgggtagagcgagttgaataattaaatgttttcattttaaatttcctcctttagataaaataaaaaccctaagcacttatgctagggcgaatagattatccgtggtaccacctaatttccaaatttctttggctcttgcttcatgtacggagttaaatactcgatacactatcctgataacgtaggaaatacgttgaagtctacttaagttttcttgttcgattcactgctcgaaggctaccttcaataattatgttgtaaagattttcaccagccatcttttctctaagactccataattatttactcttccctgtcattgcatttgtacttggatgtttatttttactcataatagtcctattttaaagaaatgtcaattgttttttatcattgataactatgtcttttttgaaatcttatcataaatgaattgcataaatatccttttgagttaataacaatttcccaaatatctaatattttcatataatattttttaccattttttaaaactttatatctacttgaaaaatcattatcattataatatattgtttctctagtagatgaataattattattttcaatagcggctgggcaaatattatcatttgcgtaaacatttggttttgataatggaacaacgatccccattagaactattatggacaacaaagctgcattaattttttaacatattatttgatataatataaaatatttgatttattatatctttttctttttctatattattgatactagataaatcaaattatgagaaaaacaataatattatatgaaagttatcatttgtattattatataaagatttatactttttgcatttgtttttaatgtatttctttaaataaagtatatcgtaattattttttgtctactaacaccttaatgtgttctttctaattttcgatagtaattttttttaaaagtaatataatagttagagcagggagatgatgtaatggcaaaatttgatataaaaaaagaatatccaaaattatatcgagcaacaactaaaaagataagtagtttaactattccgatgatcaaatatattgcaatagatggaattgggaatccgacagtgccggaatttaaaaataaatcaaaattattatttgaatttaataaggctttaaaagaatattattgtcagcaagagattgtatttagtggttcaaagttagaaggtatttgggacacctatgataatagccattttgatgttacacgtaaaaaaatgattaaatatacactaatgatgccacagccaccgattttaactgatcatattcttgaagaagtgaagaatgaagtgttgacgaaaacgggtaattgtttagcattagacgtatatcttaaagagtttgaagaaggtaaatgtattcaaatgctgcacattggaccttataatacggaaatcaattcaactaaacagatcatggaatatataacggtggcgaatcttaagttaagtggttttcatcatgagatatatttaaataaacctgaaaaagtagcgccagaagatttgaagacaattgtacgatatccagtagaggaggtttttctatgaaattaatgtttatttctgatattcacggttcatctttgtatgctcaaaaagcaattgatacatataagcaggaaaaagcagataaactaattattttaggagatattttatatcatgggcctcgtaatgatttacctgaagaatatgctcctaaaaaagttatttcgctattgaatgcttacaagaaagatattatcgcagttcgtgggaattgtgatgctgaagttgatcaaatggttttggattttccgatccgtagtgattttgcaactgttgatgtagatggacatcatttctttttaacgcatggtcatttatttgatgaggataatttaccaggcttgaatgatggtgatatttttgtgtatggtcatattcataaaccggttgctaaggaaattaatggtatctatattattaatccttcgtcgatttctttgcctaaagagggaaagaatagctatggtatttatgaaaaggatacttttatgattaaagattttgatcaaacggtagttaaaaagattgattttagaaaatcgcaataattgcgattttttatattcttgggagtaaaaaatatttgtaataaattgtcttagtaaatagttatcatattattcgaataaaaagattaaagtgttataatatataatatagaaggacgttaaaggaaaggaggaaataagatgtataagatactattagtatgtaatgcgggaatgtctactagtatgcttgttcaacggatggaaaaggccgcaactgaaaaaggaatcgaagcagaaattatcgcattgccaattaccgatgcattatctaagatggatgattgggatgtggtgatgttaggtccacaagtacgtcatgaattaaaaggtcttagaactaaaacagaaactccaattgaagtaattgaaatgagagattatggaatgatgaatggagaaaaagtattagaagcagctattaaagttattgatgcaaaataataatagtgaaaaagtctcgataagaggctttttcattttgagaaaaatatatatttaatttaatggttttttatatctaaaaaaagtccgtgcaaatttattaaaagtatggtatttttaaagagagctagatagaggaggggtagccatggtaaaatacatcgatattgctgatgatattagatccaagataatagaagagaaatacacctatggacaaaaactcccgtatgaatatgtattgtgtgtaacgtaccattgtaataaagaaacaatgaaaaaagcactagatattttagttaaagaaggattgattgtaagacgtcgaggggctggaacctttgttaaagattataatccttcgatggagagtcctaataaatctaattattttaccaaaggattaacagaacgttttgcggggataaagaaaattgatagtgagattattgctttcgaagttattccaagtgatgagacgatatcgaaaaaattgcaaatagaagagggttcgtttgtgtatcatatcattagattccgcaaactagatgataagccgtattcattagaaataatttatatgccaatctcaattattcctaatttaaaggttgatcatttgaagacatcaatttatcagtatattgaaaatgatttaaagctaaaaattcaaagtgctcataaaactgttcgtggtcatttgtcatcacagcttgaacaggattatctaggtttaaaagaaacagagccatattttgaagttgaacaagtagcttatttgagtagtggtgtgatctttgaatactcattttcacgtttccattacaatgattttgagctccaaactgttactgtagcaatgtaaagcgcttatttttgtaagcgtttttatttttttgtaaaaaattataaaaaaattttttgtaagcggtttagtgaaaaatggctatataccaacgttttttaggacaataccggttttatttttaaaagtatggtacttttgaaagtaaaaagcattgacttttaccagtttaaattttatactaatagtgtcaatagatattttaagggaggaaaaaaatatggacaaaatggcagatgtccttggccgcgttggtgcgtggtgtgggcaaaacaagtatttatctgcaattaagaattcgttccaaacattcatgcctttgactatcgcaggtgcgatcggggttttatggtgtaacgtattagttaatgcagataattacttaatttatttgctaatattataacatattaatttgtttaatcaatagtcgaatattaagataagccaaattgaaaggtatccgtttggtttttgttttactatattttgcaaagtgcgaaatgtttcgactaaaaatataaatggggcgaaatacctgtttttattcgaaaatattaacttaaaaagcacttagcaattaacttatagaagcacttagcaactaatttgcaaagtgctttttttgtcgtttttatcaatataaatttaaatatgcaaaaaaattctatgtaggcttgggagggagactgatgagtataattttggataacaaaaaaacaatggagaatattcaggaattattggaatatctttcaggaatcgtcaacggggcaagatacaacattgaaatagcatgtgaggaagataaggaaaatgatataagaatttatttaatagacaatctcgaaagagattttgatgcaaattttattataacaacttcgatattaaaaatggatgattcgaaatcaagtgttgattctaagaaatatgaaagcagaatgatagatctgttggacaaatctaatgaagaaacaatgtttcttatagaaatgtttgactgtataaataaattggataaggaagacagatgtattttgataaaaagagaaatattaaattacacaagagaggaagtgaagaatgagatgaacatatcgacaaatagttattataaacggttgagggaggctaagtatcgtttagctttactgatcccagatgcaattatgatcaaagaaatttaaaaaaaaggaaaagaggaaaaaaatatgagaacaattgtaattacaaatatgaaaggtggagttagtaaaactactaccgcactatctttagcaaaaggcatggctgataaaggatataaaacactgcttattgacagcgatccacaagcaaatgcaacagatgttgcaggcaatattggaaacgaacttgatgagaaatttatcaatgaatttaatgatgatattaagaatgaggaagatttcttaaataaattgaatgactgtttatacagtgattacaccattaattttaatctaaaagatatttttgaagaacctagttacattaaagaagtaattatgaaaacaagagtaaaaaacttagatttaataccttctgcattatcacttggtgatgcgaaaataagcttacttcataattttaatcaggacataactggatatctaaagtctgcgtttaaatatattgaagatgattatgactttgtaatagtagatgaggcaccagatgatagtgttattttgagcaatgcactaagagttgctgacttagtgattatccctgttaaaccagatagaggttctttaaaaggattaattgtttctgtaagcaagcttttaaaaatgaaggatgttgattttgacttaaaagtattgttgacgatgattaatgataataacaatgaaaaaggaattgtcaatctgttccacaaatattttagaggaaaaacattagacacaactattcggtatcgtgcaaaacctgcgaacagtgctacgatccaaaatgaatttttaatcgacagtgatcttaatattggtaatgatttaaagaaattggttgatgaagtagaggtgtattttaatgatttgtccgtacatcgataaagaaaaaacacagcagaatacaaaaactcttattgaagatttaagatcagttattaaatctggcttttatgaggtaaagaaattaaatattgctgaagtagaaaaaatttgtgatttgactactcttgttgaaacaagagtagcaaatagggcaaatgaaataataatgaaattattattaagtgcatcaagaatcttaacacaaagtgaaaaaagatttttctattattattttctaaatggaatgtgtattaaaaatcttagaaacggagtagtgttctgcgatgagtgtattgttattgccaatggttattatattttacagaacattataagaaaactgatgtattcatttaatgaaaccgttgtatataaaattaaaagagggcgaggagatattatgagcggattagaatttaatttaaaacaatatgataaatctaacagtgaggatttgatgagggaatttgataaaagaaaaaaggtagaaccgattgcaatagaggatattaaatataatccattaaatccagatttcgatacactggaggatatagtagagtttgctgataaaatttatcacaatccaaatggagtcttagaagttattacagtttatcgtgatagtgatggtaagtatatgttggtaagcggtcataaaagaattaaagcctgcaaatataatattgaacatgagagtgaattagatggtactggaaaagttcaaaagacaatagtcgcaacgattgttaagaaaccagataatgaaattgaagagatggatactattcttacttacaatgattatcgtagatttgatactgaagaaaagaaatatactttgtttaaggcatattaccagtatgttgcagtactcaataaaaacggagaatttaaaggaagaattagagaattcatttcaaaacagagtggattaggattaaaaaaggtaggagattttattgatgaacttgaaaatactgtactaatgtatttaaacgaatttaaggatgatgtgaacagaaatcttgtaaatatagaagagagaaatgattatcttatccacaaatcaggattaccgattgagacgctgcagttagtgttgacaaaaataaagaaaaaaatcgaggaagatcctaaggtgaaaaatgatgatgaagtactgacaggacagacatctatcgatgattttgtgaaagatgatctaagtattcattacgaagaagtccgtatgaaattaacaaattattttgatgcgaagtgtacggtaacaaaaaataataagattactattaattgcgtggatataaaagatttaaacagagtgttgcaaatgatgggtgtgattacaaatgattaatatgtttgaagtgtataagtttgagagtttatcaaaagacgataaactcactgttatcttaatcatactgattggaatattaatttttataatattgtgttggctggtgtttttgtacataagtgcattgaaaggcaaggcgaaaaaattaggcattaatcataaagagcagatcacaaaagtaataagaaaaataaaaaaataacattaaattgagtattatgaaaaaattaaaatttaactgaataaatgataattttttagatttgacaaaaaaataaaaacatcaaagtccctttgatgttgatttagagaggagatatgagacgcatgctcagttctggaaactacattgagtataaaacaataaaagatacagccattattaaatcttttatcaaaactaaggcttattcaaatcaagcaaatatagaatctaaaattgacaagctgattgcatatgagaaaaaaagaaatgcaactaaaaagaattactgtattaagttaagagtgatgatttccagatcattatctaaacagcaaaaacatgaacttgcgaaacagtttatgtttaatataagtctagattataaatctattccctttgtttataaatttacaaatgttggaaacgggacatacatagattttcttgtgtttgaaagaaaagtatttacaaaacctatatctaatccaaaaaaatacaaaagaaatatgtacataaataaatttacaggaaggacatgcaaaaaagatgatcctaatatggtaatgatatgcaaaaaaaatgaaattatgaaagataaagacgggaatgtcatagtagaaaagtacgatgtgactccaacaaaaattaggcatctttggtacaaggatcatagagacaaaagtattaagaaaagaaattttaataactttattgcaaaacttgaaaaattttacatcgttgcattatctaaaattattatctcactaggcaagacatataaaaaatttaaatactgtaggcgcaaatttggatatagcgatgaacggttacagcaaataaatctatataacgcagtgatcaaccgaataaatttaagaattatcttactgcaggatgcagttttctggagtgatgattatgatttatacaataaaaaactaaattcactgatatatagtatttcgaatattcttgataatggtgatatcaattttaaaaataaattcagattaaaattatcaccgttaaataaaaattatgatgattatgaggggaatattaattattttgaaaaaactgtaaatgaaagaatagaaaaatggagaaatgaagcatttgcaggaatcctggcatttataaggagtggtaaaaaatgttaaaaatagaaacaattaaacttacccgatttgagtatgaatatttaaagtttgctaaattgaaagatgaatacaactttcaatactgtatgaagtaccaaaatcgtggattaaatagaatgaagaaaaacgacaagactggctggaaaaaaacagcgataaaataaataaagcatttaatgatgctatagttgtttatcatgttagtgaactctatgatgaggctgaataaaaagagaaattgaaatgaataaaattaagaaatttaaagaagaactggaaaattatgaaaagaaatatgctttgttaataaaagaatgtattcaagaagaaattaataaaattaatccagaaattgaaataagtatacgcagcaatgatgtaaatagtatttatgttatatataagaatttcaattttgaatttagatatgtgtattttaaatgcaaaaataatgagaaattgtttttccgagggtatggaaaaactaatacccgtggatattcttatgatagatatacaaaagaagagcagaaagaacgagagcgttcatatgattatgtacgttcaatcttaaaaagtattttagaagatagcttggattaaaaggaggtaatgaaaaatgtatgtaatcaaatataacgatggaatttatgcaggaacatatagtgatatgggcggcacatatctttatccaagtagctattttaatatgcaaaaaccaaaagtttttaaaactctaaaaggtgcagaaaagcatcttagtaatttaaaaaataaagttgtttttggaaaaaatgatgatgtatatatttttaagattattgaatggtctgaaaatgatttagaatcacatttgaagtttattggagttaaacctggtaaaagtgattatccacaaaacagtaatactatttcaccagataaaaagttagagaagtattggaaaaaagtattcaaaccattgaaaaatgaagaaatagaaattacaaatatcacagtatctcataatgtatgtacaattaattatttgatgccttattgtacaggtagcgaagaatatatattccaagctgacatagataaagaaaaagcagttgatggattttgtaacacaatagaagaaaaagcaaatgaaatgattgttatgattaaagagtgcagcaatataagaaatctattttaatagaggataaaaaagaaagatgagtaaattaacaatagaagagcgtttgttacatgttttaaatggcataaaacaagtattgaataatttaggtgttgagtttattaaaaatgaagttgagtgatgtagatagaaaataaagaattagcatcactcttaaaaaagcatacagaagcgcaagaaacagctaattgcttataagtgaaattataaatgaattagctaatagaggcttagtagctgggttagaagttctatcgtgcttaaacaatacagaagcacttgtatgggaagaattagtcttaaaattagttaagggatacagtaaaaatgagcaatacaataaaggcaataagttatgaagaatatataaatactccttcgttaagaaacgtctataatgatacaattgtaaagtgtcatttgtacaattacggctgtatcagttaatggtacaaaaaggagatgagaaccatgagtgagaataatgataagattcatgatgatttagataacaaaaaaaatatagcgcctgtttctgaaggatatggtgaaaaaaataataattgttagagctgattttgaaaagtgtgctaaggaaaatgggaaaattattattgatccccaggataaatttaaatgattcatggacaatagatataaaaaaggttttgatgaatgtatgagagttcttgataaaagttatgttcttgtgtgaagatgcaacatcatttataaatggtgttgttatacctgtggatagtggatgtgtttctggtaaatagttatataaaaaaggatatgttaatatttagaaaatttaataacttttaaaatgtggttgtctaaatagatttataagaagtctgtttaggcaactgttttttttacttgttttctattatattgaataatttatattgattaattataatgattataggcgtaggaatgatggagtatataaaaattaatttataataagattaatttttatatgacaatgccaaagtttaataaaaaaaacatattgtttttaaattttgatgaatgaagggcgaatacatatgaaaaaaaaggatttggttttatcatatatacaaagaatggtaagtatggataatgaagataagctatttacaactcaagaattggttgaacattttcatatgcaaagaacaaatttatcatcaatacttaatcaattagttaaagataataaattagaaaaaatagatggtagaccagttttatataggtttatcactcttaatcaaatagaagaagaatataatatgatatttcaaagaatgatagggtataatggtagtttaaaaaatgctattaaaatagttcattcagaattaatgtaccctaataaaaattatacgttccttctcattgggaatagtggtgttggaaaaagtttttttgttcaaacattatttcatcatcttaaagaaactaaaagaatttctagcgatatcaaattatctaaaattaattgtaaatattttatgaatcacgaaaatgatttgataaatattttaaaagataatgaatttttaaaacaacttaagaatgggatgttatttgtcgataatatacatttaatatcacaagataaacgttcaattatatatgattttataactttacaatcaaaagaaaattttattttaattttttcttcgggaaaaaatgtagatgcagaatttgaaaagaactattttgatagtatgcctgtaattattgattttccggatttagaggaaagaagtttagatgaaagatttgaaattataaaagatactttaaaaaatgaagcaaaaaaaatagacaaaaattttattgttgattttgaagtattacaatgtttattattatatcattgtgaaaaaaatattaaacaattaataactgatataaaaagcggatgtgcgagtgcccatttaagagaaatgaaatacaataatttagacattcatatatatttagatgatttgcctaaatatgtgaaaaaaggattaattttttataaaaatcatgtaccggaattaaaatttatttctcataattgtttatataggttttcaaaagaatttgttgaaaaaataaaagatgattctttattagaaaaacatttggctacatacagttatttgaaagataatacttataatgaaagcttgttccaagattcaaatataaatataacattaaagaaatatacaaaacaaatagaggatcaaaatatagatgaaacgtcactaagtaaaatagtaaattatcaaattattcagattgtaaaaaaatttttaaataatgcttcctataaattgaatcgtgttttttctgattcaattttttatggtttgtgtttgcatatacaatctcttatagatcatccaaaagtaagaaattataatgataataatattaaaaaaatgataaatgaaaatcataaagaatatgtattgagtttacaactcttagatacgatagaagaacaattaaatatacatattgagttagaagaagcttctttaataactatgtttatttgtcaaaaaaatccaattatgcaagatgatggatttccagtttttttaattgctatgcacggtaatcaaacggcttcttctcttgtagaggttgtaaaatccttagtaaggacaaataaagtctatgcttataatttaccattagataaagaagcaatggatgcatataatgaattaaaatccctgataaaagaaattgatatgggaaaaggtatactaatgatgtatgatatgggttcattaaagaccatggctgaagaaattgcagatgaaaccggtattaacattcactttataatatctccaacgaccttagttgcattagaatgtgctagaaaaatagaaacaatttatgatttggatttaattatgacaaatatgaatgattgttatgaaaaatatttcccatctattgtaaataattataaaagagaacttaaaaaaaatattattatcacattatgcatgagtggtgaagggggagctttgcaaataaaaaaatatttagaaaagaatattgaattccaaaatattgatattgttcctttatctatggggagcaaaaatcagcttattatacaaatcaatcatttaaaagacaaatataatatactgtatgttgtaggaacgtttgaccctcatttacacggaatttcatttgtttcagtttctaaattatttaatgtacctgttgagaagttatcggaattatttagtgtgaatggcaaatacctccaaacaaaaaaaagggtaaaatattcattgatttttaaaaatattgaagaacaaatgccagattttgatatcgacttattaaaggacatattacttaatacaattaacaaaattgatataaaatatcctttgaatcagaatcaaaagataggattaattatgcatataagtaatcttatatatcaactagtacatcaacaaaaaattaaacaaattgatgattataacaaaataatactagcaaataagagaatatataattatctttgtgatatattttcgaatattgagaatgtttatgaaattacattatctgactcagatatagcaattcttattaaactgattaaagaaatctagctttaaaagttagattttatttttttagtgtataaagtgtatattttttcatcatattattgtaaaaaacgtgaagataaaaattgcgtattgtttcatattttttcaatatactacataaataaatcaaaaaagaataaaagtgtataaattaaaaaattagtgtataaaaagaaagaaatatccacattttaaaggatttgaagaagcttataattcattgtatattgatatcgttgaacaaggaaaatataaagatcgatcaattataagagtttgtttaatgattttaaaaaaatgaggtgaaacaatggatgtagaacaaatcgcttttacaattattgctcatgcaggggaagcgaaatcattagctttcgaagcattaagtaaagctaaacaaggttgctttaataaagctgacgatttaattgaacaaagccaaaaggaagtgaacttggctcataaaggtcagatggatttattggttgctgaagctaatggtgaaaaaacagatattagtgtgttattgattcattcacaagatcacttaatgacttgcatgttagcaattgatttaattaaagaaatgattgaaatgcgtaaagaaaaatatgagggagaatagttatgaaaatactattaatatgtgcaaatggtctatctacaagtattctaatgaacaaaatgcaaaaatggggcaaagaaaaaaatattgaattagaagttagagctgttccaatgagtgaatatttaaatgtatataaaaattttgactgtattcttattggtccacaaatttcttatcaatataacgaaattaaagctaatgcaattgatgtgcctgtagaaaaaatttccccaatggattatgggatgagtaatgtggaaaatattatgaaacaggttaaggcttgtttgggaaaggaggaataactcatgaatagttttatgacatttattcaagaaaagcttacacctattgctaatttctttggtgctcaaaggcacttttcagcgatgcaaaaagggtttatggcaacagtcagctttattttagtatcagcaatttttatgattattgctaatccacctgtgacagctgacttaattgctcaaggtggtttctggtcaatttttgaaggttggtacaatttttcacaaacatataaagcaacaattttaataccatttaacatgacaatgggaatgctttcattaatttcggcatttgctattgcttattatttagctggaagttataaattatctcaaatgaatgcaggatttacatcaatgattatctttatgattgttgctgcaccagcaaattatgtagctttggctgatggaaatgtggcttcaatgattaatactacttatcttggttcacaagggttatttacttcaattattgtaagtttacttactgttgaaattacaagaatttgtatgcaaaagaaaataacaattaaaatgccagaaggtgttccaccatttttgtcagacatgttttcttcaattgtacctttggtaattaatgtgactttattcttttcagtaaatttattaattagtaattttattccaggtagttctttaccatctttaattgaaacaattttagcaaaaccagtatcagctgtaaactctataccaggagcaattcttgtatctgtacttatccttgtaatgtggtgctgtggtgttcatgggatgatggtatttatgccattaacaacgccaattacaatggcagcgttcgctgctaatgcagaattatttgctgctggacaagcacctatcttccatccaatttttatgacacaagcaattgcattattaggtggaacaggaaatactttagctcttgttatcctatgccttaaaaaagcaaaatccaaacaattaagtgtttttggtaaagcatcaatcgtaccagcaatttttagaatctctgaaccagttatatttggtgcacctattatgtttaatccaattttaatgataccatttgtattgagtggaactgtaattgcaattttttattggttagcatgtgcttttggattaataactccattttacattttggttactggaacattcccaatcattattaatagttttattaaatgtctagactggcgtatgattgtgtttgaaatcgtagcattaatagtaactatttttatttggtatcctttctttaaagtatatgataatcagttgttaactcaagaaaaagaaaatgctcaaaatatggaaccggtaggtgaataaaatgataaacaaaaaatcaaatggagataactttccgaaagatttcctatgggggggagcaattgctgccaatcaatgtgaaggagcttggaatattggcggaagaggaatgggacatgttgaccttgttcctcaagggtgtaatcgtttttctgtaatgatgggaaatttagataattttaatgataaaaatgatacatattatccttcaagaacaggtattgatttttatcatcattataaagaagatatagcattatttggagaaatgggttttaaagtattaagaatgtctatttcttggtcgcgtatttttccaaatggtgatgaagaagaacctaatgaagaagggttacaattctatgaagatgtttttaaagaatgtcataagtatggaatcgaaccactagttacaatgactcattatgatatcccattacacttggttaaggaatatcaaggatgggaaagcagaaaaacaattgaattttttaaaaaatatgtaagaacaattttaatgagatataaagatcttgttaaatattggttaacctttaatgaaattaattgtataacagctctaccttattttgcagctggagtagttgttagaagtgaagaagaaaaattacaacaaatttatatagctgcacatcatgaaatgatagcaagtgcatgggcaactaaaatagctcatgagattaatccaaaaaataaaataggttgtatgcttgcgggaggaataacttatccatatacatgtgcgcctcaagatatttggcaagcatatgaagtggatagaaataattatttttttgctgatgttttagctcgtggatattatccagtatataaattaaaggagttagaacataagaagataatcattccatttaaaaatgatgataaaaaaatattacgtgaaaatacagtagattttatttcattttcatactattcttcacatttaacttgtgctgatcctaatgcatatgcagaaaagggtgagggaaatatgtttccaaccttaaggaatccttatcttaaagaaaaggaaagtgcgtggaaatggcaaaccgatgggttaggattaagagcgactttgaacgctttttatgatcgttatcaaaagccgttgtttatcgctgaaaatggtgttggtggtatagatgaattagaaaatggtgagattcatgatgaatatcatatcagatatattaaagaacatttacacaatcttaaagatgctatagttttagatggtgtagaggttatgggatatacttcttgggggtgtatagatttagtatctgcatcaacaggtcaaatgaaaaagagatatggctttatttatgttgatgcaaatgaccaaggagaaggaacttttaaaagatataaaaaggattctttttattggtataaaaaagttatagcatcaaatggagaagatttagattaaagatataattttctttgttgaaatatgtgaaaatggttatccacaacacttagaccacaaaacctggttcaaaatacgaattcaaagactcatcttactaatcattgtttttggaataaggtgtggtaagaacctcctctaagtagtcaaagtcacaggaatgaaatacaaatccatattcacaaattcaattttacaaatgaataaaaccgtaatcaaccacggttatataaggttgatagagaggatatgtatattgtaaatgacgatatagatgagtcatttacaatataccaggtttgaaaatgaaaaaatatcattattatattgataaattatttgaaactgtaataaatcgaagagtaaaaataaatgatacaaaaataacaattggtcgtgccgtaaaatacaccatgaatcaagtgaaagtattttataagttagcttgttttctaaattgatgtggtgttataagataattttttttgaaaacacgaataaaagtttctggattcttatatcctagattaagactgatagcttcaatagaaagtcttgtgttaagtaaaagatttttaccattttgcatacgaatttttgttagtaactctgaaaatgaatatcctgtcgtctctttgataagtttagaacaataaggaacggtataatggaattctttgctaatattttctaaagaagcatgtttataatttttaagtaggtaatcaataatctgaaaatcaggaagatttttgattatattattttgagaaattgtaatgtctttattatagttcctattaagtaatgacattaatatagaaaacatactgcaaataatacgatcagaatagatatccatctgtttatgttcttcatacatttgtaatacataatttaatatttgagagtcaccatgagtatgaaaaataagatatttcgttttagttttagaaaaaagatgatttataaaaaatatacttaataaatctttatccttgatgtagttcataaatgtatctaggaaagtactttctctaactaaaatattgataactatagaattatcatcaaaatttttaacaccgtgtgaaatatgaggggctataaggcaaaaatcacccttttttaataatagttcagtatcaaaaatagtattatcacattgtccatctagaacatataaaatttcgaaataagcatgtttatgctcaaagtaaggaatataacgagggtgttttataatagaaatattatgatttttttttataaaatcatcttcataatgatagattggtagagattcgggatgtagtgcaatattaagatttgtagcatcattttgattttctttataaaaatattcaatattttgtttagtcttatccaaaaaataatattttttaaaaaacaattcatctttattaaaaaaatataattcctctataatattcatcacaatcacctatataaattatattataaaattaaaaataatcaataatattgattattttaaatcattataaatacagtttttatatgttatgataaacatgaaatgaaaggagaaagggaaagatgaatcaaaataaaaatatattattgaaaattgctttattaagctgtgctgttgttacagcatccataaatgcaatagccgggaatatacctgctattgcagaatcgttttccgatgttccagtacatattattgaactaataacaaccataccgtcattgtcaatgatgatagcaatcctgtgtagtagtttaatctctggtgttataggaaataaaagaacagttctaataggactgctattgtgtggattaggcggtgtagcaccatatatctttcaagatataattattatgatggttacaagactactttttggatttggagttggacttatctcctcaacgttattaataatgattatttatttctttgatgggaaaacaagaagtcaaatgataggacttcaagggagtgttggaggattaggtagtctgatttgtacttatattgctggtcaacttctaatgtttggctggaatgtttcttttttaacatatttagtatcatttattgtttttttaatagtttttttatatgttccaaatgttacagatgttcaaagttctaatgaacatagtgggtcaaaaatatgttggagtaaaatttttctatatgcagtactttcttttatttcagtaactctagcaacattttttgttattaagtgttctacattgttaatattaaacgaatatgggtctgtacaagatggctctttacttgtcatgtttatatctgcaggatctttagtatcaggagcaatgtatggcaatatttataataagctgaagaataaatcacttatattattttatttgatatgtgcaatttcgtttgtaatagcctcagcatctagaagtctgttattaacattattatcagcttttatattagggtatggatatatggcatttgtaccatttcttcaagaaaaggtaggaatttatggtaataaagggacaacaacattattagttttccaaagtttaggctctttcattgctccatattttggcgctatattatcatactttagtgatacattaagtcatcagttttttatagctggacttagctatatagttttaatgcttgttgcctacattataaaagatttcacatagaatatatactaatgatttggtagtgtggttcaaataaaaatgtcataggagataactatataaatcaagtgatttttgattatataaataaaatgatgtaagagtgcaaaccaattattctttcagaaaaatgaaatgactatgattttagattttaatataagtgaattagaaaaatgttttgaagaagtattacaaaaaaatataaaaaaaaccagaatatcaggtaacgttattaaaacatttgaataaaaaagtatagattattttggttatttcttactttagagtataaataaaaaggaggatttaaatgctgttgataaattcaatagtttgaatcctctaatttataaaacaaaaaaaggtgataatcatctgtagtgattaatcaccccgtggacaaaatttattttgtcccttttttatgatttcttaattttggaaatgaattgataaacggtgtaaacaatattattgtgtaaatataaattaaaaggaggaaagaagatatgaaaaaggcagcagttattgtagctccagggtttgaagaaggggagacgttatctattatagatattattcgtcgtgctaattttcaatgcgatatgatcggtcttgaaaaggatgttgcaggagcacatgatattattgtgaaatgtgacagcgtactaaatgatgaggtaattgattatgatatgattattttaccaggagggtatcccggtgctgctaacttaagagataatacaaggttaattgaaattttaaatataatggcacaaaaaaacaagtatatttgtgccatatgtgcagctccgattgttttagaaaaggcgggattactaaaaggaaaaaactatactgcttatgtgggatacgagcaaaaaataaaacaaggaaattacttacatgataaagtggtgattgatgggaaaattgtaacaagtcgcggtccagcaacagtttatgcatttgcatataagctggtagatttattgggtggcaattcactagctctcaaaaaaagaatggtctattttaatgcttttgatgttaaggaggatgaatagtatgagaaaagctgcagtattggtagtagatggatacgaagaaagtgaaacagtgacgattgtagacttgttaagaagagccggaattgagtgtcatacatttggttttgctgaacagtacgttagggggatgcaggggatgatgataaaagtagataagatttttagtgatgagatcaaaaattatgatatgctggttttacctggcggaagaccagggggtgtgaatttaggagcaaatccactggttattgaaatggttcaatactataatgaaaatggaaagtatttagcagcaatatgttctggaacaattgttttatcaaaggcaagagttatcgacggtaaaaatgtgactggctatactggatatgccgataaattagtaggtggagaatttgttgataaggttgttgcttttgatcagaatattataacaagccaagggccagcaacatcatatccatttgcatttaagattatcgaagtgttaggtcaagatgttagtgaaatgaaggaaagactattatataactttgctggtggaagataagtgaaagtgagtgataataatgatctatgataaattaccgatagtttttttaagtacgcttgtcagcgaaaaaaatggctcaactaatagccagatagcagcatatattttgaatcaccttgaggaagttcaaaatcttggaatcaaggaaattgctaaggaatgcaatgttgcggtaagctcaatttcccgtttttgtaaagaagtaggtttaagggactttgctgaattaaaagaactgttgttgtcaacagatttatcttttgaagatcattcacacgcaacttcgaaacaagcaagactgcatgattatagtcataaagtaagagaaagtattatcatggttgaaaaatcaattgatatggatgcagtaattgatttatgtaaggatatcaatgaatatcaaaaggtagccatttttggtttgttaaaagctggagcagtagcttttaatttgcaaggtgacttattaatgctgaataaacaggtatatactaatatctcctattctcaacaaattcaatatattgttgcggctgatgaagatgatttgattataattttttcgtatacaggtgcatattttgattatcaagatttaagagctttgaaaaaaagattaacagcacctaaaatatggatgatatcgagtgatgacagagagtatcctgaatgtattgatcgaacaattttatttaaatcgttacaagatcaaaacagtcatccttatcaattacaatttattgccggactaattgctcaagaatattcacgtttgcatcagcttaaataataggaaagaatgacttttgttaaaagtcattctttttcattttgttcattttcttgaataattaaattagtaatttctcgtgattccgtatttttagcgagttcagttttaaaagtataatgctgatcataggctgttgtaaaaaagcaagaatataatacatctaaaataagtgagatggattctagtgaagaataagcaccaatttttgaatatgatttttctcttgttgtaacccgtaaaacaatatcagctaatcgagttaaactattttcaccaatacttgttattgcgataatagggacattctttttctttaaaatattagcaattttaataatttcaccagattctccagaatatgaaagacaaattcctaaatcattagaattggccatcattgcttcttgatagatattgctatttaacacaaaaacttcagcatttttaccgatgtggcgtaatttaaaaacaaattcttcagctggaaatgataaattagaaacaccaaaaactttaacagtattacttttttgtaatgctctcactgctttttgcagtgtatcgtgatgaattaatgaaagggtatcattaagactttcagtttttaactgtgttattttgttagcgatattcataattgaatctgtttttaaaaaaggttgattggcatctatatttaaatgacttttgtgcaaatattgaacttcttctaaaaaggcgtttttaaaattattataaccactgaatcctaattttttagaaattctaaccaatagcgatggtgaagtatatgtttcaccagcaatcatcgttgtcgaataatcttttattcgctcttgttttgttaagataaaatcaataactatttcttcacttggagaaaattttgtgtttttcattttttcttgtaatagcattgctcgccctcctggtattatcgtttctattatattctatcataacaaatatgataagcaatggattaagcaaagcggtttgtaaaaggcttttacaaatgatacttgtatttataaagataaatgagaaagcttttctaaaaggataaaactagctttaatgtcatctttatttgaattaagataggtttatcaaaaggaggaagatttatgaaagtagttgttattggggcatgtggacatatcggttcatatttagtgcctaaattagtgaagggagggtttaaagttgtagcaattagtcggggtaaaagtaagccatacataaatgatcctgcttggaagatggtagaacaagtagttttagatcgtaataaagatgaagactttgcttataaagttgctaaaatgaatgctgatattgttgtagacttaatcaactttaatatcgaagatacgaaaaaaatggttacagcattgaaggaaattaagatatctcattatttatattgttcatcgatttgggctcatggtcgagcagaatttttaccagctgatccaaatagtttaaaagagcctttggatgattatggagttgataaatatcaaagtgagttgtatttaaaagaacagtatcgcaaaaatggttttccagcaacgataattatgccaggtcaaatttctggaccaggctggacaattattaatcctcttgggaatacagacttttcagtatttcaaaaaattgcaaatgggcaggaaatctatttaccaaatttaggtatggaaactttacatcatgtccatggtgatgatgttgcgcaaatgttttatcaggcaatcactcatagaaatcaagcattaggagagagttttcatgcggttgaaagagaatcaatgactttatatgggtatgctaaagcaatgtaccgttattttaatcaagagcctaaaattaaatttttgtcatgggaaaaatggtgtaaatatgttaatgatgatgaattaatagatcatacttattatcatattgcaagaagtggggaatatagtattgaaaatgcacaaaaattgttagaatattcacctaaatatacaaccttagaaacagtggaacaagcagtagccagctatattgaaagagggattattaccttataattaagaataaatataaataaaaagagcataatgattttatagaataaaaggagcgtacaaataatgattgaaccagatactataaaattattacgagaatgtgatgcagggattaagatgggtgcagcttcaatcgatgatgttttagattatgcacatgatgaaacgttaagacagcatttaattgactgcaaaagagaacatgagcagttaaaagaagagattcaaactcttttagataagtttcatgatgaaggcaaagaacctaatccaatggctaaaggcatgtcttgggtcaagacaaatgctaaattggttatgcatgaatctgatcaaacgattgccgatctaataactgatggatgcaatatgggagtaaaatctcttaataaatatcttaatcaatatgaagcagctgatgaaaaaacgaaagatattacaaaaagattaattaatcttgaggaaaaattagtaattgatattcggcagtttttataaatagcaaaaagccttttacatatagtaaatggctttttttattgttgaacttaatttaaaagatagatcgaaagatttaaataaccagcaaaagttacccaaataagatatgggagcattagatagccagctaatttatttgttttgtaaaataggattgctgttattaagataagcagccataaaattattagccaaataaaggcaagtaagtacaacctaagattaaagaagataataggccaaataaaattgaaaaaaagctgaatcttataaatgaaaagagttacatgctgagaagactctgtagtcaagactagataggatgctattcccattaaaatatatagaacagtccaaacgattggaaatagccatcccggtggtgatagcactggcttttgaattgtttcaaatgtggtcatagcatcgtgtgtaagaaatgctgaaagagtacctacaaaaaggggaataataatacatataattaatttctgccattgaatttttataaaatcacctcatcaaaaatatatgaaaaaaataaaattatatgcttgttgataaaatttagggtataatatcctgagaaaaagagttttagagaaaaggtgattgtagattactgaggttgtggtaaaataattatgtgatgagctagatataaggaggaataatcatggcattatttgatgatctaagtaaaaaagcagcaaaactgacagaaaaaacaattgaaaaatcatctgaattagcggatgtcgcgaaaacgagagtgagtataaaaagtgctcaggctgatttagatgagaagtttattgaattaggcaaactgtattatgaaattattagtaatgataatatttttgatgaaaagacagcagcaatcgttcaggaaattgacagtattaatacacgaataaaagaattagaagcaaatttggataaataaaacctgttgaggatcatacttcaacaggtttttcatattctttttcaatatcatgccaaaattcagcgtttttaattcctaaattatcagggtggaaaattggatcttttccttcctttttttgaatactatagtcttttaaacatttaaaagcaattttacctaacaataaaattacgacaatattcatgattgccataaagcccatcaaaacatcagctagatcccaaatagtattaaaactagcttgggcaccaaagaaaattataattacagtaataattctaaaaataaataaagcttttttgttgtcaataataaatttaaaattactttcagcatagcaatagtttccaatcaaagaagaaaaagcaaataagaaaatagaaattgttataaaatgaataccaaattcacctacttcagcaaaaatagcttgttgaacatacggcattcctgttaatccagattctgtcccataatttagtaacataaaagcagtagtggaacaaattaacatagtatcaataaaaacagagatggtttgtactaaaccttgttttacaggatgagaaacatctgcggttgctccagcgttcggtgcggatcccattccagcttcgttagaaaaaagcccacgtttgattccatgcattacacaagagccggcaaatcctcctgcaatcgctttaaaatcaaatgcttgattaaaaatatcactaaatatttctggtagctgattaagattgctaaaggttatgtataaaccaagtaatatatataaaatagccatgactggtacaactttggagctaatgatcccgattcgatggactccgccaaaaataaccgcagcagtagctaaagctaaaactgcaccaataacaaaggcaactaattcattgtttgaaaaataatattcgacggcactactaacattatatgcttgcaatggattaaagccaaaaataaagcaagcaatcaacagacacgaaaaaataattcctaaccagcgttttccgatagctttttcaatataataagctggtcctccacgaaatgagtcgccgtctttttctttatagacttgggctaaggttgattcaataaaagcactggctccaccaatcagagcaattatccacatccaaaaaatagaaccagctccaccagcagccaaagctgtagcaacaccagcaatattaccagttcctactcgtgatgcagttgaaatcattagtgcttgaaaagatgaaacaccatcatcatgatgtgatttttccttaagaagtcgaattccttctggtaacattctaaattgaacaaatttagttcgaattgtaaaatacaccccggttgcaacaagcagagcaattaaaatattgctatataaaaattcattgattaatccaagtaattcttgaattgatatcacgcattcacttcctttcattaattaatcttgattataaagcgcaaaaatgcattataatcatacttttgtatgttaccatgtttgatttctactgtaaataagaatgcacaaaaagtgtatccattaggatacacttttagacaaattattgatgatacttatcctcaaattcttgtaaaggaattggtttagaataataaaacccttgaataatattgcagcctaaacaaaccaacagttctatttgtttttcagtttcaactccttcagcgacacaggcaacattaatttttttacacatttcaattatatgatgtaagatagtttgacatttatcgttatttactaatgtgtcgatcattgatttatcaatttttaattcatcaaaatttaaagttgataataatgacatatttgcatatttagcaccgaagtcatctagtgaaatattaaaaccgagatctttaatgcgcttagaaatcgtagcaatgatactacgatcgatatttccaatgctttcagtaacttcaagagttatgaaattgttaggaatattatacttatttttaattcgttttaaggaattagtaaagtcagattctagaagggtaaggcgagaaatattgacagaaataggaattaattcttttccttctttttgccaacgctcaagaatttcacaaatttgttcaaacatataaaaatctaagtaacgagtcattcgttctttttctaatgtgggaataaatttatttggcatgattaagccgtgaccgggatattcaagtcggaccaaagcttcggccgaaacaactttgttttgatcaatatcaaattttggctgtaagtaaacaacaaattgttttgctttaaaacatttgagaagattttcaagttttttaggtgaatagtgttttttatatgtatcagctcgttcatagtatatttgtttgttgatcatcattaattcttcggcttggtgaatcaaatcattaatatccatgttatcttcactccatgtgtatccaagtgagacaccatttggagttgaaccgagtaaagtatcttccatctgcttagtagcttcaataaattgtttatactcaagattgtttacaataatgatgaattcatcaccacttaatctaaagattttttcgcttgggaaatatgaattcataatactagaaataatcgtaattattttatcaccatggtaatgtccaaaatcgcgattaatttctttcaagccgttgatatctgcaagaatgactccttgagagtaaacagcactattttcataactcaaaaattgagtaaaactattacgattaagtaagccgcttaagttatcgtgataaagattgtactgtgttttttcatataatcgacgtttctttatctcgttgacgatagaaaaattgatagaatcaagtaatgcaattgtattttggttaattgaaggattgtcaacaccaatatagcctgcaaaaatgccagtttcctcatagggaattgtcactaaagaatgggcttcacgactaataaagtgtgcatattctcgaggatgctcttttttgatggcttcacaatcattgataattagattattatgatgttcaaaagcttcataaatataaggaatttcatttaaatcaatccgctgtagttggtcacgatagtgaggatagttttctcggcaccattcataagtgtttgaaccaatttttgtatttaggtcaatttcaacgatatatgctcttgttgcttggtaaaaattgccaatgatctctaaaacgttgttaatagcttcttcaagagtgtccggaattgtcaaggcttgaagacaatctaaaatcgttttttcaattgcaaattcagtaggaacacgttgaagattgaagttatgagtatcagaaacatcaacagcaatttccattcgcacaggtgttccttcccataatactaatttatctttaacaatatagtctttatttagatgctgattgctaaactcccaaatataaaattcattaagatttaatttagcattagtacaaaatgggcaggggctagttcgaccttgtagagcttcgtaacatttaatatgattatattctcccgcttcaattccggtgatttcacgtccctttcgatttaagtatagtaattcataagtatctaggctgctaacataaacaatttcatcaagttcatcaattagccagcctttactaatataattagttacaggagttatatcctgatagctatcattaaaagcaaaatattgcgatttgcccagtttttttgctcgatagagagcagaatcggtttgttcaaacaattcgtgtaatgttttaccgtcatcagggctaaaagtaataccaattgaactgctgatcgtatattcttgataatttgatgagtaataaagatgaagttcttcaagaatgatactagctttatggtaaacatatttcttggagggaatatctttaatgaaaataatgaattcatcgccgccataacgcccaataattgctttgttattaaaaatatttgttagcttatgagcaatctcacataaaacggtatccccaaaactatgaccaagattatcgttgatatttttaaagttatcaatatcaatcaataataaagcactactagactctctttttttatttaaatattcattaacaatttgaccaaaagcggttcgattgtatagtttagtgagcggatcggattgagattggcgcaataattctaattcatgtattttcttatcattaatatcttttacatagacaaagccaaataatttatttgtttcaccaacgtgtaagagatgaatcgttgtactgacccagccttgtttttgagttgcattgagcgaacgatattcacaatatacttccgtaatcccctgttcaaataatttctttaaacggtgaggatgtaattcttggtagaatttatttttatcatcaggatggacgcattttttagtccagcgaagtaaaaactcactataactacagttagtgtttaagtcaactagttttaacatgttaacggtattttcgataatatcttcgataattaaatcatcatcaatattaatttcataggatactaaagcatctgatgctattgctgctttaaactgtccctcatgaagatatttttgatgactgatttctagattttttaaaacttttttgttttcagtaatattttcgactaaacaaattatatatactgactgattattgtatataaaggatagtctagaacgagtccaaatcaagtcattatctttattaaatgattgagtctcaatttcgagaaattcttctttcttttgaatgatactagtaattgtattttttactttttgataatcattagaatagggaagagaatagttgaagccgtcattacgcttgtatttaaaaagttgataataaagatcattagcatattcaaaatgaaaattatgacgatatgtaatgattgcacaagcagtatttaaatggttacagatcttagtgatcatatcaagattatatggattaactggcattctattttcctccttattaaattagaaaaaatagctctacctcattatactactaaagcaattatatcggttgaattattttaatgtttgattaatattccagcaatgatctaatggtccactgccatgacctaggttaagattagcttttaaagccccggtaatatagactttagctctagtaacgctttcttcaattgaatattctaaagctagattggaagcaattgctgaagaaagggtacagccagtgccatgagtattaggattattaattttttctcctgtcaaccaagtaatatttccccggtaataaagaaggtcatcagcccgttcttcaaaatggccccctttgatcaaaatgtagccgtggtaccattcactaatcatctttgcggctgtaatcatgtcatctttagtattaatttttaaatttgttaaaacctgtgcttcagggatattaggggtaataatagtagctaatggaataagcttttctttcaagagtcttagagcattgtcagctaataaacgagatccgctagtagaaaccataacaggatcaacaacgataggacaatctttttgtgatgttaatttatttacgatcatttcaattaatactggactggaaaccattccaattttaattgcatcaggataaatatcttcaaagacacagtcaaactgttcggctaaaaaatcaggttttacttccataatatctctaacacctaatgtgttttgggccactaaggcagtaataatactcatcccgtagactttatgagctgtcatggtttttagatccgcttgaactcctgctccacctgttggatcagttcctgcgatagttagaacttttttcataatcatctctccatttctgataaattttttaaatttaaatcacttattttgcaaatttcatcccaatcatcttgattactttgatctgcaacggcccatactgtaaaaccttgcttttttgcagcaattattgcatgaagggcatcttcaataacaatgcattcatctttatggaggtgtaatgcagagattgcataattgtaggcctcgccactgcgtttatctaaagtagtatgatcacatgtaataatttcatcaaattttgatgttagattatatttatcaagaatgttaattgttgcttgataattatttgcagttaataagcacagttttttatgatggttaaaacagttagtaataaattccaaagcccctggttttaaggggatttcgcttaaataaatatgattcaataaactattaacttcattgattaaaacatcaagaggctcttttaattgatatgtctcagcgatgtatttaattgcttggttaattgatagtggtgccaagatatctttaagatttgcctcaggggtaattccttttaattcgagaaaacgactgcctaattcattccaaatgtgcatcgaatcaagcaaagttccatccatgtcaatgatataacctttaatcatagattcctcgggcatgtgcttttaatttagcggctgcttcttttatatcaggagcgctcataatggctgaaacaacagcaataccatcaatttttgttccttttaagagtaggcaattgtcttggttgataccaccgattgctacaacaggtaagccaatttttgtagttatttcatgtaattgggtaaagctcactgctgtagcatcatctttagttgaagtattgaacatggctcccactcctaaataatcagcaccatcttccttggcggcaagagcttcttttaagttgtgagcagaaaccccaataattttatgaggaccgattatttttcgaactcttttaacaggctgatcatcttgaccgatatgaattccatcactgtctacagccaatgctacggctacattatcgttgatgataaagggaatatggtatttagaacaaattgttttgactttttttgcttgaatagtaaattcttcatcagttaaatttttttcgcgtaattgaaccattgttactccacctaaaatagcttgttcaatatcttcttcaagtgaacgatcgttcaaccagctgcggtcgctgactaaatatagttctagcatgtttctagtgaagttcaattttaacaccggctttcaattgataataattaattgtactcaaggcatcgattaaatgcattctaaaactgcttgttccactattgtcattacgaactctttgatcagctaactcaccacagtatcccatcattgcaatcgtataagcagtagtttctaaaagatcattttgaccaatagcggttgttgctccaagaattgccgataacatacaacctgttcctgtgattcgtgacatcattgcacaaccgttagtgattacataggttttttcttgattggcaacaatatcaattgctccagtgattgcgattacggcaccagtttcttgactaaatttcttagcaaaactaataacttcattaagattttcagatgttacaatatcattgatattggcatcgactccttgagttgaagtcatattcattgctagggcttttatttcggaaatatttcctcgaataacactaaaattaatttcttcaagtagtttttttgcagtattagtccgaagtttgctagctccagcaccaacaggatcgagaacaacagggtgatttaaatggttagccatttttcctgctttgatcattgaagcaactgtcctttcattcagcgtaccaatattgattactaaagcattacagattgttgtaatttcctcaacttcatgaatgtcatcagccataatggggctgccattaacagctaagatggcattagcacaatcattgacagtaacatagttagtaatgcaatgcacaattggattgcgtaatttaatttcttctaaaactttttcaaacatattcttcctcactttcttaaagcactaaaaagagaatatgccaagtgccatattccctacttattgttagtgagtatgtccctacgttggcattatccaaatcaggttagcggtcgaagttcacaacttcctctcagcctgtttacaagctcccgtgctttaactatatcatagcattttcaaactatttcagcaaactaagtatcaaaatttttttgcgttgataataaaagaagattgaaatgcataattatatcgagtataattagtagggttagcgttaaaacccagaacggagcgataaaatgaaaaataattatgatgttgtggttgttggagcgggaccagcaggaatcatggcctgctatgaactgtatttgaaagcgccttgagacgcgagcaagcaacataggcttatagcctcagagaaaaccacgtcttttaggcgtggtttttattatgagtaaaaaagatactgtaaaatatattattgatgaatatggtgttacttcagcaaatgatattactaacgctttaaaagatttattaggtgaaactcttcaggagatgctggatacttaattcaatgaacatatgggatatgatgaatatgaccagactactaaaaaagataattatcgtaatggcagttctgaaaagactataaaaactttacaaggccatattaatatcctacgagatagaaatgcatcttttgattctgtgattattgaaaaatataatagagatatatcagatattgataataaaataattaatctgtatgccagagggatgtctacaagagatattagtgaatctattaaagatatctatggtattagtaaaataactgataaaatcattcctgcagctttagagtggcaaaacaggccattacacattatatatcttatagtttttattgactgcattccctttaatataaaaacagaaaacatggttgtaaaaaaggcagcctatattgttttgggaataactgaagacggctataaagaagtactgggtatatgggttgtagaaaatgagacagttaaattctggttgtcagtacttacagatttaaagaatcgaggtgtaaaagatattttaattatatgttctgatggattaaccggtattaaacaggcgattgaatcagcttatcccggtacgatacagcaacgctgtattgttcatttaattaggaattcatgtaagcatttaagttataaagatcgaaaagaattctgtcatgatttaaagagagtatacagtgctaatacagaacagagtgcattagaaaacctggacagatgtcaagaaaaatggggtaataaatacccgtatgcgtttaaagtctggacagataactggaacgaggtatgcagtatgtttaattatgctccagagttaagaaaaatcatgtacacaacgaatgaaatagaaagcttgaacagtgcttttagaaagtttatcaaagtacgaacagtatacccgacagatgaaattttatttaaatcattatatttggcacaggataaaataacctcaaaatggaatgtaccttacgccaatttgggagtgatatattcaagtcttcaaattattttttgaaggaagagtatagagttcattgacaacgaatatttctatgataacattataaaaaatagtaattacatgattactcaatgtaattactacccatattctactaatgaaatttgactttacacaaaattgtttacaggctctaatgaaaattcactgatttctaccttttatatttggcttattcaatcttttcatttagttagttatttacttttatagtttcctcgttttttaccaggttcttttattctttgtaagtgttctaatgaacttggcattgagttcttatttaatgaaaacattattctgttcctcgttcttaaaaaatttctagaaccatttgtatttttttaaatcgttttgattcatgagtttgttccttcaattttcccattggatattctttgattgttataaattgtaaatgaatttctgatttcgtttacaatttaataagagttgtggaaaattctctatattcttcaatatttgatgatgaatattgtttaatgacttctgccaaattgactctggtatcctctgttgtggaaattgaattgaaaattaaatataattctttaagcaaaggatcaatattaagaatgagttcaagaagcgaggacaattaatatatctttttagcttttattgtatttgactttgtttttcgttatgtttgaggaatctagcattataagaaagttgaaatgtttgagaagataatattcgacggaatgcttttcataatttttattctttcattttttagggtagtattgaattgtctggggtcatggaaaaagtggcggaacgttctttaagagctcatcatttgaatttcgtaagcagtagtgaaaatagaatgcttttgagtaaaaaaagagctgttttcataatgacagctgttataatgagtacaaaaataacgtcttttttataggcaatatgagaatccgttccatgaatgacctgggggctgagcctaacattgtgataatctttgatgctaagtttatttgaacagcttgaacgaataaactccttacgaattaaagtgacaaaataagtgatataattattttctttttctgatgcacaagactgtacaccagagtgatttagatttaaaatattaatgatatcatcgtacatgatattactcctttcatgctagattgaattaagcactcaaatcatatcacgaaaggactttttatttcattaaaaaagtcatctatttgatgacaaaaaaataattaaaagtaaccttttaccccagaagaaattaaagttccgaatgatttacggtcactttttctattataaagcaatatttatattgaatattgcccatatatattttacaattcaattgtaatgcagagtgttttaccgaagttatcatcgatgatttcagtatttaaaatattaatatctttttgcttatacacttctaaagctttttttcctcgttcatataggcaatgataaaaacattcaatcatttccccattagttgttgaaatcaaatagttattacaatcattggccattaattgactttttaataattcattgaatgtcatgagtattctcctttctctatactaataaaatagcatatctattaaatgaataatataaaaccagcaatagttggtaatggttacatcatatgtaacaaaaataagtaatattagatgatttgaggtatagaagattaaactttccattataacaccagtgttaaaaaagagtataattctagatgaggagggatgctagtggatatataacagctcaaattgctaaaattattgggattcatccgaatacagtgatattatatgcaggacttgggttggtttctccagcaaaatggtaaagtaatggttatcgtatattcaagaatttacatcttaaacaattttatttagcaagagcggcattaaaagttgaaatattataaaatgaattatggaaaaaagcaataaagattattaaagcagtggtaaagtgataacttgaaaatgcccttagtttgacaatttttttgatatctcattttatagatgaaatagaggtgttgtgcgatagggggtgattttaacaagtgggagaagactgtgttttcagggacggttaaggagactgtaaaaaacagtacctatagtaagtttaaagatgcatatctttggtatgccaaggacggataaatgtgtgaaagaaaaaaggcaaaaaaagataaacttaaaaacaaatcgtaatgagaattaaaaaaacttaataaataattaactattttgttgaatttctggtatttgtatttgagaaatatctacatctaaagattgtaaatgtttaaggacttgttttgttgtcatttttgattgatttatttttggatttttaaaggaatcataatcagatggattaaaattctcaccagtcttaaccatatgataaactgatacaagcagtattctggcaatgactattatcgctttcttatgaccatatttttttgattatattatatttgattttgaaatacagttcattattactttttatggcagctatgacacattggacaaggataggtttgctgccttagatatacgagctgatttcttcttgttggcactttcgttattttgtgtagtaacctcaactcaagaagcaacttccttgtctgatgatctctgatgatcatttattcatattaatgccaatttctgaaagaataatcattgatgatataagagaaataccgggaggctgagttatatgttttacagtgtcaatgaaagatacacaacgattaatcatttcaatttcactatcttgtatgtattcatcagattatcaaggtgttttatggcgtactctaacttaaagcattgggcagtttcaatgcgtgaatgttgaatggtctgtataacctgtagataggttacactaaattggacagtttttataagaactgttacaataaagtgttgacaatctagcaatcactaagaagggttccaaatatcttagaaagacttgataacagataatattacctgttatcagtaatagtccaatatttaatgactactacaaattaaaactttctcaagggaaaggttatcattatgctcagggacattgtgtaagaaagatgcatagaattgttttccatttacttaaaataaatcagcagtttaatcatatactattaaaataaattcatcaaaatcagagtagaaaaaattggccttccttaagttcttttcgtcatatcaaaaaacaataaatctacattcaattttaaatgatccctccatctgatttataaaatcaataacttaagtattttcaaatttttcattaaaaactattgtattttatatagttagctctctcatattataactgttttgctaggcatgaattatggaaataaacaaattttaaaaaggtttaaagtcagtgtaattagtcttttgatgcttttgattatacaagtagcaatctatataatttactctttaatatcattattgttgtttatttgattactatgatattttttaattttcaaatgttaggttcgccggtattttatttaggtatttttattcttgtggtgttatcaatgcttggtattgggatgatgattgggggaattgcttcaaatataaaagttgctaatatgacagcaagtttattatattttccgataattgtttttttaggggcgactttgccatatgaaattatgcatacaagcttataaaggatttctgattatttgcctttgatacaagcaataaaattgttgaaaggaataactttttgggtaaaataagtagtctgttttttttggtttttataatacttacaattattacggtatcggcatatcattaagatcttttaaatggtaaaaaaagaggggctcatgttttcatgaacccctcatatgtcgtcaaaaatttaacttaataacatcgggtctaagactgcccttgatattattgattaatcgattgaaaataaagatatgatatcagctgttgacatcttagtaatacttccgtcattattttcaataaaaatatttgataaatcttgtttctgagcttgaagttcttggattttttcttcaatactgtttttcatgattaatttataaacttgtacgttattggtttgaccaatgcgataagcacggtcagttgcctggttttgagccgacatattccaccatgggtcaaagtgaataacaatcgatgctgcggttagatttagaccggttcctccggcctttaaagaaattaagaaaacatctgtattgtcattttgaaaagcgttaactaattgatgacgtttgattttattggttgccccggttaaaacgtaatatgatatatcctctttacgaagttctttttctaataaatctaaagagctggtaaatgatgaaaataatagaactttttgattgttttctttagctttctttattatatctagacaagctttcatttttgaactaggaccaataatttcattatatagaattctagcatcgcagcagatttgacgtaatcgtgtcatcattgctagaatttgaattttatcaattcgttcaacgtctaatgctgtcttaagttcgctattaatttgacttaaattagctatatacagattttcttcttctttattaaaagcaatcttaatgttattctcaatcttatcaggtaattcttctaaaacttcttgttttgttcttcttaaaataaatggttcaaccattttctttaaacgaatttgagcatctttatcttcatcgcgaacgattggacgctcaaaatgttctctaaaataattgtaattatataaatagttaggcatcaaaaaatcaaaaattgaccataactctgcaagtgagttttcaattggggtacctgttagtgcaaaacgatgagtaccatgtaactcttttactgctctggcattttttgttgcttggtttttaatgtattgagcttcatcgagaacaatatattcaaatttaaatggtttatataattcaaaatcccttcttatataatcatatgatgtaatgataacatcgtagttgtttatttgttcaatcatctttttacgaacggataatgttccactaatacataggacattgagatcgtttgagaatttttttatttcatcctgccagtttaatattagggttgctggggttattacaatactagctttgtgattctttttagcgtcttctaatacagtaatcatttgtaaggtttttcctaatcccatatcatcagcaagaattcctccgaatccataatcgctcattgttttgatccatttataaccagtacattggtaatctcttaaaatatcactgaatggttcaggaacaggataattattgatattgcagttagttagatggttgatgagttcttggaattgttggttacggttaaaattaattgtttcgctatcttgtattaattcgtttaagaataatgctttggatttatcgactatgatagcgccatcttgaatatttttgttttcaagatttaaatcttgaattaaattataggcttcatttaaagtttgatcttctaaattcacaaattcaccattttttaaacgatgataggctttgtgtttttggtatgattctaaaatatctcggatttcatcttttgaaacattaatactgtctaaatcaatctctaatagatcattttttaaacggataccaatgtttaaagaaatgtttttaggtttattaatatttttaatgtcttcactgacaaatacatcacaatatctatttaatttaggcaaaatattttttataaaatagtatatatcttcatcgttattggtgattaaatacatattcgttagttcatcatattgcgcgtaatcttcaatcattgctagtgctgtatcaacgttgagtggcagcttggtttcataactgtcaatatatttaccgtcaaataatatattaccttcatcatcacgatactcaagattgattgttaaatcaccaaagttattcaaatcaacgtaagtaagtaaagtgatcacactaggcatataatcgtcgatattagctcctgtaatggcaatataaggtaagatttgatcaatgatatatttgccaaaataaccaaaatcttcttttgcgacaatgagattttctttatctaatttagaaatcagttttttagtaattttagacattttaagactgtaacgatttaaaatgtttttgtctaaataatataaatattggttaccaataattaattggccgcctaatggcaaaagtgatatttcaaagtaatcttctttatcttcgatgttgattgttaaattatttagatcaatagtggtaaaaaacatattgatgttaagatttgtgagatatgtttcaaaaaattcatcaatattatatttgttaatatcaatagaacgatatctttcaatatcatcaataaattcgctattatcccgaataaaatcaatttgttttaatgcttctgaactaaatgatttacgattgtaatcggttgttaactgactaccgtaagtatatacattgtgataacgatagttatatatgaattctttaagattttttattaagtaagttttattttgaccaattcgataactgatcaagattcgattaaatgaataattaatattaggaattaaatcaatcaatgaatcatttgttagttgaggatcttgctgattagtgtagtcggtaattaatttttttgattcttcgagttttgtttgaattaatttttcttcacgaacgcgttcaaaggcttcaatttttgctttgtaatcaattttttgattaaactgaaaaggaatttcagacatttctaaactataaaattttaataatagtaccccaatatgaccacatgctaattcatcattatggcaataagggcaatcacattcaaaattatttatttttcctccagtatctacgacgatatgacaagtactactacgaccatatatttcaacagtaccatcaatgtggtactcatttccctgttttagaacggacatgtttgtgattacattatctttataataactgtgagcaattttccagtttttttcattaaatatcctatttatttcatcatctttaatatacatgttctttccctccgatagaatattatatcattattttaatgattaccaaatagataacattaaaaaaagataaataaaaaaagatattttatgacaaggaataaagtgttataatatgaatgcggttacttatgtcggtatagctctaacggtagagcaatccactcgtaatggataggttgctggttcaaatccagttgccggcaccataattttatttcaataactttatctgattatttagaaaagttatgaatgtctatatatgaagcgataaactgtattcaatttgtcgctttttcgttttatcatattttaaaagaaagcagaaaattaataaatgtaatataaagttgtaatcgattttataaattcaaacatttaattatagattgattttttaattacatgaagaatatgtgaagaagtagattatatattctatttattcatttataagttcattgattctttaaattggaattaaccataaaaaaagatgaacaaaagttcatcttagtgtttcaaatggtgacccgcaggcgattcgaacgcctgaccctctgattaaaagtcagatgctctaccggctgagctagcgggtcatagacacttaacagtgccatataaaaataacatagttttgaaataatgtaaagctattttgggaaaaaataaattaatttagcaatgtttttcttataatgatgaaaattgttataattattcagcataaagagaacatgaattagtaaaagaactaactgatataataaatagtcctaaagattttgatctttaggacttctttttgcttgggcgggaaggtcatatatttttcgtagctctgagatcgtttgatagattttaggtttataagtttttaaagcatttttttgataatatagagaagcaattttttgatataaatcataattatatttttttatacaattaaggaaatagggtttagtttgccctcgtaaatagagagtaccgggtaacacataatcagcgtttactttttttgccattttatataatccatttaaatttccgggttgatcagtgagataagggataattggcataatgtgaataccagcatgagctttagtttcctttttgatttggtcaattactttaaatcgttcaataatgggtgaacttcctggttcgatgattttacgtaagtcatcatcaacagtaataatagtacaagcaatattaacataggttatttttgataattcattgattagttcaatatcacgaaggattaatgatgatttggtagaaataataataggtgttttatacttaatcattaattttaaaatttctggcattatttgtaattgttcttctaaaggctgataactatcacaaacacccccaatattaactaattcgtgtttccatttaggtgatgataattctttttctaaacaagataaaatattctctttataatagatcgtgccaaaataatcattgttgtcaaggtatttatgactgtaaatagcataacaataaatacaaccatgttgacagccgcgatagatatttaaatcccacttaaagggaaatcgcccactaactttatttaaggcgcttttagattctaatggttgatatttcattttatcaccttctgatttaatcataacatattgcttgaaatatgtatgtaaagaatcgttgttgggaatattaattctacataattctaataattgttatgattaaataaaaataaaaaggatgaatggtgatgaagactaaatatgtgttagtattgatggcaatgatgtttgttattagtggctgtagggaagaggtaacaaaggaagtaggagatacaacgattaatattgcagaactaaatggcaaaagagaaattgataaaaacgataaaatatttgcgaataataatcaagggaagcatgatttattaatgttgatggctaatagtgtggatcattataatttaattagtggaacaatgctttcaacgttaagctatcaaggacaaaaaagtgaaagcaagtatatttttcaagttaatgttccagaatatcagtcatatatttgtttagttccttcaaaaaatgaagaaagccaagtaacttttagagatagtgaaagaatgtatttttttgttggagatttagtgagtttaaataataacttagatgaattaatcaataagcaaatgatgacagttgaggatgtaagtaaagatgatagcttatttaaatataaagatttgacacttgaggaaagggttgaaaatatggatattagtcgagtagctaatgatttgtttggcgatgtagcaccatatttattacctgaagatattgcactcagacaaataggtactgcttataataattatgaaataaagggagaagaaaaatatcttaatcgagatacttatagagtagaggggaaaataaatgatagtctctataatagtgatagcactttttctatgttggtcgataaacaaactggaattgttcttaaatatactaggactacaaaagatagtctggtagagatgaagatggaaggtatttcgattgatgaaatgaatgaagagaatatgtatgctaaatatcttagtcaaaagtagaatttttactacttttttcttttttgataaaaaaataaatttttttcataaaaagggttgcatcattctagggataatgatattatattagggcactaagttgcttgaatagctcagttggtagagcaatcggctgttaaccgatcggtcgtaggttcgagtcctacttcaagcgccatggcctgttggagaaacggttaactcacatgcctttcacgcatgcattcacgggttcgaatcccgtacaggtcaccattatggaggtttagctcagttgggagagcatctgccttacaagcagagggtcagcggttcgagcccgttaacctccaccatttttgttataagccggcttagctcaattggtagagcaactgacttgtaatcagtaggttgagggttcaagtcctttagccggcaccattaaatatgcgggtgtggcggaactggcagacgcactagacttaggatctagcgccttcggcgtgcaggttcgattcctgtcacccgcaccattatttataaaatttactcaagtgggtaagttatcgttcgatagcttacccacttttttcgtttttaaatgatatttcaaggaggtgagataaaatgatagtcgatactaaaaaaagcgatacggtggaagaaaacaaccgtagagcagagcgtttgtttgaattgatgaaagttaatcttattccgtggatacgggatctgttaaaagaaaatgaaatgcagcccagcgacattgaaaaaatgtttgataaaaagaaaaggatgatttctaatgctatgagaggtgattatcagccgtcaattcagttttatataaaaatgggaatagttttagataaatctccaggagaggttcttgacagtgttatcctttacgaacaaaaaaataatataaaaaagaaaaaaacttaaattaataataactctgtttggcgacaagggctattaatttaagtttaagcaaaaacacgaatacccggattgtatcaaatttcaaaatagaaaccgttagaaactgttaaaaaccgttagaaactgttaaaaaccgttagaaactgttaaaaaccgttagaaactgttaaaaaccgttagaaactgttcaatcaacacaactgtatagcctgtataaccagtgtaaccagtgtaacctgtataacaaactgtataacaaactgtataacaaaccgtgtggcaaaccgtgtggcaaaccgtgtggcaaaccgtgtggcaaaccgtgtggcaaaccgtgtggcaaaccgtgttttgtaaaaaaatgtatttaattaatacaagatgattatagcaagattaatagactatttcaatgatttcagtactgaaaatacggtatgaaataaaaaaaacattaaagcggagctttaatgtctatttaggaggacaacgatcagatgattaccaataacacttacgtgtcttacgatacatgcggttccagagaggatataaacagctggcttaacaccggtcatgatatcttcagcaaccgttcagactacaagacagtgatagcacatcagtgtgattataaggacatgcattcttatacctatggcagaaagaagaataaaaaggtttactctaacatctatgcccatcagatggaggttatgattccagttgctatgacggattcacttaaacatgattttatcaaaaaatttatgtgtgcagtaaatccgctttataagcttaacagtttcctgtactgctataagtttatcactaaaggcaaaggaagctacattagtgttctgtgttttaccagaaagtatttcaaaagacagcggttaatgaccgttacctatgaaaaggattatatttacagcagtaagacaaaaaggctatgtaagatggatgatccgaacgcagtacttgttcataagaaaggtgatgtaaaaaaagatgaaaacggctctcctgtaaaagaaactttctttgtttctaaaacagagcaggaaatatttaaatatacttcttttatccgatttcataaacgtcttttaaagaatgccgaatatgctgctatgctgttagaccgggatttctggaataaaaaaataaaatatttttcacggataacaataaaaaaatctggttttaaaaataaagaaaagatagatataaaaaatcagctgataatcaggctgaattcccgtattaattctttgcagactgcattacaggaaggcaggtactggaatacttcaccggatattgaaaaagcctttcataggatgattcattgtgcttcattaaccatctcatcacaatttttagaaatcacttgaacatgtaagcttctatcttttccaataatatcccttacttttctcatgtgatcaaagaagttttctggtgcagttgcttttacaatagaagggttgcttgtcacccctacgatcggcatatgatctatagcatctttaatttcctctaaattcacagtatcaataataaattccatttttatcttctccttattctatgattaaattttttaaacctgtttgataaactaactgatgaaaatgttccatctgttctttatcaaacatcttcaattgtttatcaacttcataatccagatcaactaattcatattttgcaaaagctaatggattgtaattcaacaattcgtatttaacttctggataaatattaacaagaaaatttgcaatactttttatattatgatcagtcgccgtcattgtcggtatcaatggtgttctgattataactttgtttctatattcactttctaaaatatattcaatatgctgttttatcatttttgatgaaacgttagttaattccatgtgtctcttttcatcaaaaacttttaaatcaatatatattaaatcaagatatgggagtatttttttgattaattctaatgatccatacatagttgtttcaatcgcagtatgaattttctcttcttgacaagcttttaaaatctcatacaagaattctccttgcataagcggttcccctccagaaaatgtcacaccaccatcatctctaaaaaacaccctatcttccttgattttttccattaattgttttatatcatacgcttcactatcataacgaatagcattacctggacaagcttttaccaaattatcaaaagttccttcatattgcaaattgaaatacggacgattattttcatatttaatttgattttttttagaaaactccacacatctttgacaatgaatacaactattttcaaaatatattggtcttctttgagatgataatccttctggattttgacaccatttgcaccttaatggacatcctttaaaaaaaactgttgttcttaatccatatccgtcatgaacagcaaatcttttgatatcaaatactaaagctttagatatcttcataagccgtcctttcaataatctcatcttgcagcttaccagccagttctacaaaataagctgtatatcctgcaacccgaatcgttaatgacctatgttgttccggatgaagcttcgcatccaacaaatcttcacgtcgtactacattgaattgaatatgtggaatttttaaatctacaaaggctcttaaaaagttttcaaatttcatcattcctgtttcagttttaaaaaactctggtaaaaatttcatatttaacaagcccccatttgttgtatacgaatccttcatacgtgataccgattttaaaactgcagttggtcctgccatatctcttccataaactggtgacattccaccatcagctaatggtgtcaaagcatttctaccatcaggtgatgcacctacattttcacccattggaacatgagcacttactgtatacattccggtatgatatagaccaccgcgataatttgtataatctttcattctttccctaaaataaccagcccatttagcccctaattcatcgacccattttacatcattgccatacttcggtactttatttaaaagcatcgtttggataatttcatatcctttaaaatctgcttgtaatgcttctaataattcatgtctggtaatcatcttttcatcatatacgagtaccttgattgctgcaagtgaatcagctaaatttgcaatttgtatcatctgaatccctgaaagattgtattttgccccaccacgtgttacatctactcccttttccaaacaagaatcaatgaccgttgataaaaaagctgtcggcaagcaatcttgatgagctttttctacaacaatctcagctttcatcattttttctataaaataatcaatttgtttttgaaaagcattttccaaatcctcaaaactctcataggtttcaatacttccaagatccaaacctattggttcattagttaaaagacattttccatgattcatagttaattccagcgctttatttaaattgaacattgcagcatcagaccagcccaaattgtttccatgtgtcgttaattcaacacatccaacaattgcataatttcttgcatctttttcttcaatacctaaatctttaatcatactatttacaattgcctcatcattaaagaactgtggcatcccactacctttagcaactactttgattgcttcctgtattagttcatgtgaagaatttttatttaatcttactgataaattaggttgtggtaatcctagatggtattgtgcttttaataacagtagtgataactcattataaatattgcatccattttcatcaattccaccaatcgctatattaaatccgattggaaaaccagcaaaatattttgcactgtgctgattcctcaaatacacaatttgattaaactttaaccacaaacactctaatatttctaatgcctcttgctttgatataattcctttttcaatatctttttgataataaggataaagatattgatccattcttccaggagaaaatgatgatgcattagactccatgtgtagaacaacaaataaaaaccaaagtgattgtacagcctcatgaaatgactgagcaggtcgactagcaagatttgcacaaatgtctgcaaccctttgtaaagatttcttattatcatcttccagactttccaacattgtcaaaatataatcatgataacgcatcataaaatggcagacaccttctaaaacaataattgtacattcataaaattccttttgattttcatcacaattttttaacttttcataagcttttgtcatcaatccttttggtccaagctctagccaagtcttcgtatctggacaaatgtgtccttgagcatgatctttttgattaattttaacaactttagcaattgcattaatttcctcaccataattctcttttatgacatcttccaatgaacggtcttgccaatatggataaattatctccttaaattcttttacatcttccttttttattcggaatttatcttgtggtcttgttggtaaagtctcaaactctttgttaacccaagaacatccactttctggaaatactactccgtacctaacacctttagtgcgattcccaacaatcaattcttctttttctacgccaatttctaattcttctaatgctgctttcaaagataacgctctttttttaggaattgataagctttcattttcttgataaatcctcgttataattcgtgcctgttcaattgaaacataacgtggttcatttaacattttttcctttaataaagtaattcttggagtttgttctaaattatccatagctaattctcctcatctcatttttatcgttttttattgtttgtaattgaattataatacatatacaatatttttcaatatattttcaataaaaaataataaaaaagtggctttaaaccactttatcataaaatatctaatccatatttattaataagttcccgttgttgaagcgttaccgccttttcacaaataattcccgtaaaatcatctatatgagaaaaaacataattcccgtctaattttaattttgccgtttcagccaacatataactctttttactagaattaatcacttgctttttagttaatccatcatcgatatcataagttgtaatatttcctgaatgtaagtcaattccaaccacacctaaaaatgacaagtcaaatttataactctttatttggtctatagtaattgcacctaagaatccgtctttaggattattaaattctccaccaataaaaatcaatcttgctcgacattcacctctaaaaatattgatcaattcaatcatattagttacaaccgttacgttcatatcacgctgatagataagttttgccaactcaatattaattgttgaaattcctaaaaaaaccattgttcccggctcaattatttcaactgctttttgagcaataagcttcttttcaggtgaatttaaaccaattcgttcaccgacattaacacgatgaagattagttcgtatctgtgttgctccaccatgaattctctttaattttccatttttttctagtattgttaaatctttacgaatacaatcttcggttacattaaaatccttacttaaatctctaactcttacttgcccttctaaatctagtttagcaataatctgattatgccgttcttgttgtaacatcatgatcatcccttctttgttagtattatgccattatttaaaataaaatacaatgactataaaatttataaatatgcctaatacttttcagccccttttttaactatctttttatccactgtttagcttatacttaagtaattgaggtcaaagttattaataaaattattaaacgtaataaaatgataagtgtaaggagggattattattaaaacaattggctgtttagtaagtcgcaaacgaattttagttgaatttattattagtattttgggtctggatctactctatgccattttttcaaacacattcaaaaagcttaattttttatctacaaaatccagaattgtattcaccaaccattatttttatgatgattgcaataatcattgtcactgccggttacggaaatcgacaaattattgtcattgataaaaaatattttaaatattgcagtaatcaaaatttatggtttaattaccaacaattttaccgcattatttttaactgggaaccaacatttgacattcaaataccgctagttaatattgcaaagattgccctatcatacagtgatatttatatactatgcaatcaaatttattgaggctcaaggcgttaaaatccaggattcctatcacttaaaagaagctttagctaataaagacatgcgttttgctgaatatattgaaaaaacaagtaatcatttttaaagaaattacatctattcatgacctgaaaaaaatttttctccacccaaaatggatagccactcaattatatttatcattgataatcaagaattagtgttcctttcattaagttaccatcctttatgctttattggaaaaaaatgatttagaaacagagcttaatcacgctatttctttgttattaaacctgcataaaaatattgaacaaattttaacttttaaaattgggtattcttatattcaaataaaaatcaatcaaataatttggattgaatcattagttactatttaattatccacactcagcttggtcaatataaatttcgaaaaaacttagtcaattactcgatgaattagctgttaatcaatttattcaagttcacaagagctatattgttaatcaaaaccacattgttattcgaaaaagtaatgaaatagttttaaaaaataaaatagctattccgattggtcggaaatttaaaaatactaattaaaataaaaaagagaaatagaaatgcctatttagcataatttctctttttcgttataactacttttgtttatttacttctcttcttttcatttctaaaattccaataatcactaacaatgaagctgccataaaaatcattggtaacattgatgaagtgtcatcaccagttttaacaatagaattatttaatacatctggatctttatttacttctgcttgtgtatagtccttagcgactaatgtatagattgaaaaacgatcagtctcaaaagtaataatattttcatttgctaagctagattttaagccattagcttcattatcgtgcagtctaactattccaaattgacggtttttcttaataaattcactaggaattgtcatagataatttgattggagacgccatttcactaatttctacaccatttatttctgggatgatcacgtcatcttttgaataagctgtagccgtaatagaaatatcgtaataagctaatattttcgctccatcctctaaaactttttcaatcttatctttctgatctatcgttatgtcactttctgttagatttttcaatgaaagttgagctttaataacagttccctcaggtaaatttcctaaaatttctgcatagtgtttatttaaataactcatcacgcttgtttgaactactttttgcgattcttcagcaagctctaatttactcccacctaagtgctcaaccacagtttctacagttattttatcagcaggatcttgtccattatctcctgagtcaccaccagacacacttgataatattactgctggacaatcgaattctatactattttcagctttatcatttacatatacatatgtaatttttgctggtgtaaattctatttcaaaatctttattactatcaattctaattgttcctaaagtaatctcttgctgttcaaataacttagttttattcgataataacaaatcaattttattttcggaaagattataatcatatattgaagctagtttctttaatccttcgtccaacataaatgcattttgatattcttgaattgattttgacgtattaatagataaatgcatcgttgcaatttgacgttcaaacatttcttgacttaaatgtagttttactgtcaactcatcgccagcttgattaggtgtcaaaataatatgtggcttatctgttgtaatttcgtgttcattatcattaatagcataaatattagttgataaagataaacacattactacagctataaaaaattgaaatatttttttcattatttaccacctctcttttgatttccgattgtgattgaaggtaattcagttggaattttcacttcaaaagaatcacttactaaacgttgaccagcatttgtttgagcatcgttaacgcgatacaactctggtttaattgagccaggaagttcaactttaacaaaatttccttcatcatcttgatatccaaagctattttctatgatttttccattttcatcagtttcaggaattaaataataaatccaagttccttcactaacatcagctagatccccatctccaggatcttctgcaaaaatagcttgatagccacttaaaatttcatctttattatatcttaattccacaacattataagctggatttccagcatatgttcctgtaaagatcaatgatccctttggaattgtattatttgcatctagtttataatcaccgcttaatataccaatactattttcttgcgacatatcaatattatcacctgttggtcctaagacatcaatttccgataaactaatatcattttcatcaacagcaacaatcttaatataactacttgaatatgaaaccaatgatttattattttctaattcatcattaacaatctgactaaaatataatttattttcttcacctgtttttaatgagtcttcttttactaaagtccagttgtccttatcatcacttacatagatctgtacttgattaaatgacgggttagttaatttaaccccggttatgtcagccaaagtatttagtgaaacaataaattcaccttgttttgtatctgtactccctttataaacattttgataattgttatcaattaaatcgtttactgctttttgttctggtaaacatggtgttgaatcttcatcaccaactgcttcatcattatctgaaataagattagtttcaatcagccattgatctttatcaagacttccatcatgagaaattttgattggttttaaagtcaactctgcagttcgatttaataatttatcatatccaatgattgaataagtaaaaacacgattattaacagttgaaacagtatctgtaaatgttgtttcaccagtttctgcatttacaaatccaactgcttgaccgtttcttaaaatttcataacctaacattgctccatcaactttatttgtgttagaaatagttaatgttacttgattactatttttgtcatttgataatgatgcattaatttcagtgtctacagacattctagctttaccatctaaacgataagccattgaatcgtcatctaaatattgtattttatctgtttctgcttcaaattggctaataaatgctttagtttcttcatttggaataattccccatgctgtaaagaaatctgttaaatctttgttagctgctgctgaagctaaacgtacaaagttttgttgagcatcactgtttaattttaatgcagtaccaccttcaggaatattcaccttcccaggattacgagcataataatctactcgagcaaagaacaatgaatttaattgttcctcgtgtgaatcatataatttataatgataattttgatcataagctaaatgtaattgccaatacattgccaattgtgtaaagacattacttgacattccaaccgtatttgaagttactttttcataaacatctggatatttaaatcttgttgtatcattagaatcacgattttgtgataataatgagaaatagttattagttatttctgcaattgcataacttccttgattaatgttatgtccaatttcatgggcaattccccaaccaaataaagaacccgataaatattttccattttctgctgcttcaaatggaattccatttgataaaccagatactgaaccccattcaattccgatatgatttccaccagcgtacataaaagcaccagcaaacattctttgataacggatatttaaatgctgagcaggatagcgatcattaatagcagctgcattttcattaagtcccttattttgatagaataattccatcatttgatccattgcatttaatgaatttaataattgatttgccttttcatctaatgttgtaccttttaaaccagccatgatttgtttacctgatactgagtacagcatatgatcaagcataatctcagtagctcctaaaatacaatttttctcgtcataatcatagttaacactattgtcatcacgatgaagttcttcgtgttttgaagccattttattaatttgtgtttgtaaactttgaagataagtttttactttttctaatcgttcattttcatcactaacttgatataaatctaatgtagcaatcttttcaccgcctgatactctaacagcaatcttttcattagaattaccagtatattgaacatacacagatccacctttttcaactccgatagactgtaattctttcatactgatttcatttttaccaacttttaagctaattggactactaacaaacgaagctgattcagcatgatattgcgaatatacaagttgtaaattcacagcttgtccattacgttttccttcttgacctacataaacgataaatgtatcaccaggatatgtaacatatcctaacggttgccaagagtttaatcctccaaatccaaggtttccttgtttacttgctgcaattccattatgaatctcttgaatattttgtagtgcagttccctcaacaacttgtcttgcttgattaagctctaactgaattaaatctttaaatggatgtaattcttgggatacctcgtcaggtgtattcaatctagtttgtaaatcatcaagcgttgtagaagtaacatcatctcttacagttaaatggaatgaatctgtaaataaagcattgacatcttcttctaatgaatcatagtaataaaaattaaactctgaaatacgcattgttcgatttgaactttgtactccaaatctaactttattagtttttattggtttcgcaagatgagcgataaaataaattcttccgttatcatctgtttttcttctgaaagcatcgatcgaagcatctacttctttaccactttcatcataatatgaaattccaatattattaatactactatcattaactggtccagcaaatgaaatatagttcatttcataggtatcatcaaattcaaacgtcaaacgccaattacggtgataactaactccaaaatcccagtcattgatttgtagataagaatcatagttatcatctactaaagctaaagcgctattagttgtcgtactcacttcatctaacgggctatttacgatttctgtaactccattatttccgtagtaaacattattgatatgatttgataatttcccttcaccatttgaagtattaagcaatttatattgtggtaattgagcaggtaaaatattaaccgtcgttgcttcacttactaaagaagctggccctgtaccttttttattattaccagtaacatatacttcatatttagtattatcctttaaagaagtgattgtatatgaggttccttcgtatttacttacagcctcaatatactcgccattccccttttcacgataaaaaacattgtaagaatctgtactcttcatatctttccaagatacattaatcgagcgataagcaccaactgcttttacattatcaggtgcatcaggaacttttgaagcttgtggtgtagcctcaactgcagctgaataatctgattcccaaagtgaatttttatcagcatcattaatcgctttaacactaattttatatgttttaccatttaatagatctttatcgttaaatgattttaaattaaatgaattgacattagaggcatgctcctcagtcttaccattataggttatttttactttataacctgtaacgttatttaatgcatcccacttaatatagagttcttcatctaactcatcaactgtaattcctgtcggaatatctaattttggggcaggaatatgatcttccatcccatttaaaaactctactttagaaatttctgctaatgatttagaagatgttcctgttactttaatcgtaactttttttactgcaatttgagttcctaaatcaattacaattgatccatcagcctgaacgattgcttgtcgtgaagccatgcgagcacgtgatttagctgtactgataactgcttctatctcttctccattctcagcgacaacaattacactaccttctgttattgcattttctttagtgccttgaatcgtcaactgtgtaactgctactggctttttaacttcaagactcatttgaatcggattactttgtgaaatttcttcatctttttccggctttaacttaagcgtttcttcttgagctgtctcactaaaaatattttctatttttccctctaaagttccttgtaactcatcattatttaatgagacattgtttactaacaatggctgagtttcaataactggttccaatcttgtaacttgagtagttccattatcactataagcatatgtaaaagtgtgtaaatctaataaatcaattttattattatcatcaatatctaataaagaattagaactatcattattaaaaatggcagtagataatatttttttatctttgctatcaattttaccatccttattaaaatcaccatatgcaaatgtaccaaatccattgccttcaatattatcagcaactgagtttgtattgacatactttacagtagtttcactgttattaacaacaacctctttactaacagtttcataaccatcaccttgaattgttaaagtatatgttccattaacaatattcttaaattcaaagatttgactattttctttagtcgaatctaattctccagtgtaagtttgttcaatattagctaattgtgctgacaaagtactaatattctttttaaaatactgcgtattaataatcagttttactttacccgttattgaagaattcttaacatcagctgttttttctggcgacgttgattcattattaactgttttttcattagttatcattgaagaatcgttttcattttttgttgattcaccatttgtaactgatgtagttatttcttgcccctgactttcattatcagcataaatagttaactgtgttgaccccagcaaaacaactacgacaagaaaaaaagcaagtattttcttcattgtaattctcctttcctatttgttatttttgtccatttaatgggcttaactcgcattgcaaatcaatgttacgttatttatttttactgtgctgtttctattttatgcgcacaaaaaaatgcacacataaaaatagcgtacacatacacgaatgaatgcaactggctgccatatcataattgatgaaggccctatagctttgcgtacttcttttttcaaagagtttgccatatttatgaacgccatgattatacaatgactatgtgataatgtcaaaaagtttgcttaaaaaatgtattataaaaaaaacaattttattttcactaaaaaaacctccaaaaccaaaataatcacctttatatcatgttatttttattccaactcctctactattttaaaatcatatttttacatatattaaaaattaactcataaaaagtgttttatcctttgagttattgaactaataataactttttgaaaataaatacaatttcccaggtaataaatttcgatatttattttatataacaaaaaaatgactagttaaataagctggtcatcttttcgttatattatttattacagttaatcaccgattaaaagactaatttctttattttcccaataatattatcaacttaagaccagatcttttaaacaatttatcaattagaattgaagcctcaaaggcagtcccggatgtcctgaatttgccttttcaacagtatcagcgcataatgctctaatggtactgactgtttaaaaaaagtgcttactccacctaatttacttcgtaaatatagatggagaatgcgcactaatgattgaaatattcaaacagttcataagcaactcttttataaagtcttataatcgtaagtatggtaagtaatatgctaattctaattaatactttcgtaaatacaactattatcattacaatatatcttctcctatttttctacattctggcataacagcctagcttcagtcaatgtaactgttaataaaataatactacttataaataaataatacacttttggaatatctataaaaatagatattatattccatactgacattaagaagattgtcacatttaacagttctctaaagctgttaacttttaatatccaactaactttcatacctaccttttttatcttttttttcataagtttaattattttcatcgtattcataacatcccttttgtttctctttcataaaaatatctaataaattatcaataatttgttctgttctatcatcctctatattcgtgttttttcatacttaaaaatagcggattaattataatgtcttagtatttcaagtatcagcataagaagaatatttggttacttctgtatgtaaatcaacttttttattcattatccacaataggaaactaatcatagctggtccacttattaagcagagcatgaatcctactagacatagtaacattctaataccaaaattccttatttccacaacatttcctgttaatgctgatatcagtaaatcattttttgatgatatattaataaaattaaatatatcatctttaaaactcaaaaataatttgaaacaaatatatactgtgatacaaccaataataaacaatagtaaattaattattaataaggttctgctgctaatttttattttgtctctgccagtatctgatatatcaaatttattaccacagtattcacacataacagctccagtagttacaatatgtccgcaaatattacacttttttttcatatattttattaccattttgatttcactcccttttatcagttctataattgtttcttcgaattttctaacattgcattccatattgtcatagaatactctcgctgatctgctttagtacattaaaattattataaaagacattataaactaaacgttttattatcatttttctccctatttctttgtatacatctaaaattttctttttcatctaatcgcccaccatatctgttaaaatatgtaaccagcttatataaatttatttttacttatttctgattactatctcatctatgtttacctctaatgcatccgcaatagctattacagtagatattgttggctcttttatttctccatttaatattttttttagatttgtacgatcataatttatcatttttgataatttatatactgttatatttctttctttcataagttcaattattttcatcgtattcatatatttatccatgggatcaataataattttcccattttctttagcccacttttcaaactctgctctatcgatcatcatcttttcaccatgtccttcagatgaagtcacgatttttttgcgtatatgaatttttttgttatctaaatcatttccataccattctgcagtttcaaattcatcacaccatacaaatccatctgcatgtttcataatatatttttcagctcctttcaatgttttaaaaatttccgatttacacgtattaaaataactacccagacatagcagcatctagtaagttttttacttctttatcacttaaatttttctttcccaaatattttttccaaagtgtaccagtaaccgatacgtttttattattcaaaattgctaaaacaaaaacagccaatacccaagtgtaataaaagcaagcagtaaaacagctttgcagaatattataaatagtattgtaggaaaaaaatattcatgaccatattcaaaaattgacataactttccacaaatctcttatagaaagtactattcttacaattttatttttacttctgtcagagtgactgatagagtctctataatctatgtaactgcatcttatatcatctactgcatcttttacccatctgtatacaggatataaacaaactgctgaacatactgctatataaataatttttaatatttctttcatatctttacttctcccatatgatatttatttttaattatgcctaatcactatctcatctatgcttacctctaatgcatctgctattgcttttacataactgatccgtggatcctttgttttacctgatataatttttcctaaattagattcgtttaaatcagtcattttacttaatctgtataatgtaatatttttttcttccataattttaattattttatcagtattcattatctaccttttgttcctcttttcataaaaatatctaacatagtaatttacacataatttcttctatttttccttcaccttttatataatcatttgagtttttacaaggaaaaaacaaactggaaactaagtgcaaaaaatctgaaacaaatccaacaatcctttatataataaacattcaattattaaaaagataaaacctataataagaactactaagtacattctattatcattgttttcttgtaaatctttttctactatactaattattgaatatatcataaataaaactgttattattattaaaggtaccatcaaaataattgaaaagcctgtaatataatcccaaagatttacacttgtagtttctatcattattatatgcccctccttattcattctttttactacactaacttcgtcagttaacatcattcttctatttcttctctaaataagaatttcttattttgttaattatttcatttaattctatttcaaattcattatcagatttatttaaaaaataaactaaatcaatccaccagacagattttcctaatggtttccaaacgtctttagatccatttgtatctagcaacttaaagtcttttaggtatttaagataattcttaattatagtaatcgccttttcgtggcagttttccacgccttcaagctctattattagaatttttactttacagtaaataaacgataaattattcaaaatactttttgcctgctgtttagccaattcgctctcatatttacctatatatttattaatttcttccgataacttttcttccttcaccatttaattttcttcctaatttctactctaaatttttcatgagaaaaagcagtaatattgcagttcccattacatataactcttttgaaaaatctataaataaatagataagattattcattgatatgaataaaatcgcttgatttcttaatttctttctatccactatatcccccttctttctataaaaaagataataaaataaaagtttattatcttttttatagtaggtaggtcatttgacctaccttatgcaattaaattgtcataaatagtagtgtaacttaaactactatattattatttttgtaataacgttatcgaagtttaggttattcacttctccctggaatttcacctgcccatgctactgagcgcctactttggcgggtttcaatctctctgcaaaagtcatggccaaatagttaccatctatttttatacaatgtattaatcgcaagcgtacatttgtaaaaggctctttttacaggatctgttaaataacagcaactatttacaatttgattatttaaattttaaatagtcacaaggaaaattaatgatatttgcaatatcaaagttttccttctttcctttgaaagatagatattactatttatttgtcaaagaactgaaaaagttcgtttaagtatacttaaacgaactcgatgaaaagtaataaaatatataaaaaaaagaaattaattgcttaatttcttggttaaaaaacatatatttatatttaatttcactgtttaaaaaagtatgctttttcaaacttatataccataataaatcaataaattggatcaattaattgaatatagatatatattttttaattaccttttaaatcattatggtaaatgtgttaaatcaatacaacacatatataattttaattacttttttctaattttcaatacgttttttctattttatttcaaatatattcatctgctggtacatttcttttttttccgtacttattactccaaatttttcatttatttctttataataacttgataaatcaagatcagcatcacaaatattattaagttttataattttaattaaatacttctcttccaaatattttttttcatctaaaagccttttatacaacatatcactgtttacaaaccatatttgtacataatttgaagtgttaaaaattatatttcttgacagcttatttttttgcttaactgacaattctacctctatttttattttatacttttcgcataataaatcacaaatatgctgatttcttatttgcatatattccatttttctttgcatatctctttcagtcttaaaatcatctattgaaagattatcattgaatctcaaaatatgatttaatacttcagcaacttttatctcatgatcaagtgttcttttgtttattgttggtgctttttttacttttttgtatatttttcccgattttgaaattgttattcttggcggatacaaataggccattcctttttttgtgacagtgtaatatctttttgtagtcttactttcctgataatatttaacatatccctctgtaacaagtttccgcatcctattcttacatgtaccttcattaatgcctaccaatgaactaatcaaatttatatctaaaactctcagtttatccaatgcttttaaaacctctaaatcccgctgcaataaacgcattttcaaatatccctaaatatatatgattctatatttttaacgtctatataaggcattttaatcctatatggtttaaatccatctgacattgtatcaatccaataccctatacctaacggaagttcctttagatcattaggatgaactttaaactcatccacaattttagaagttccatctcccgttttaccaaaagagtcaagcttacttgttatttctgctttcttcttagttccaattgcattggccaatgtctctgctgatttatcgtcagcctgtttaagcagataaaatccatgcatatttccaattacagagcgtcttatattttcatttacaacatccatatctgcaactgtttgagttgataaaatattagttccacctaaagaacgagatttattgacaacatcaacaatcatatcacaaaaataaacacttaactcatcaaatacgcataaaaacttttcatgcttgccttttattttagtaatatctccaagtacattttttatatcgtttaataccagctttcctactccacgtgcaaaatcagtatactcaagtttatttaataaaactaaaacaacagcattttctctatatgcctgttttaaattaaaatccctcctgttactgtcaaatattcttcttccttcgccatgagccaacgtagaaaacctagatagagatccttcggctgcttcgaaacaccgtttatgaacatttatataataactgtaatcactgacatctatagaaagtttatacatttccaatgtattcataaaatcattagctgtttctattaatgagttaaaagatatattaatatttgctttgatcataaaatctgccactgcttgaaaatattcacttgccagagctttataatgttcttcagaccactccgacatatttataagcatatcttttatttgtgttgcattacaatttttaaacggattatagctgtgtgtttcttctggaattgtctgattaattatatatagttttctattctttttaatacataatttggttacaatatcatataaagaatattcaccattatctcctttaccatccataattatacaaaactcattatcctcaatgtgtctggcagtaaaattagatatagctactgttttaccagaaccattttttccgctaataaatatatttttatcataattcaacggtacattgtcaaaattatctaatttctctttttttattctatgcagcttgattatctcgctatttctatttattcttgttgtctctttatacaaaagtaaagtggccaagataaaactccagacagcataataaaataaggatgtatttaaaagactaatatcatatataattttttttgaagctaattcattaatttcatatacaaacgtttcaaatttttgtcctgtcaaataagatagaattaaaaatacagtacataataaataagtaaaccaatatacttttgccactgacttaacataaggatctatcttagaattaagcagattataaagtaaacatgatacaaatactgtaactaatataggcataatagacttaattatcaaaagaattagtacatttgataaataatcataagaaatataaaccactccttccacttgcattatttttttaatgatttaaaataggtattgtcagatataccatgcgcaagcgtggttatttttttattttatttcttccagaaaagcacaaatagcagcatatataaatccattttcgttatataatctaaattcattttttgtcatttctaatttatcattggtattcttttttagaattatcttttgttttttatctgctccatctacattttttctttttgttggaatacttaaaacataatttttaaaaccttcatccgccctcattttttcgcagccataatcaattgcacaatttaaagcttctgttagatttaaattattatgattcgcaaaatctttcaattgttttttttgttcctcacttattctacaacatttaatatagcgtggtgatccatctctttttctgtctttaaatttttcaaaatcaatatacattcacttcacacccttttaaattatttctatttcatcaactgcaatagacaaatgattctctttatcaagatctaatcttccccaaagagtcacttttgttccttctctacatttttcatatatataagtagctttttttccacgtatatcacacggaattatatcgtatgttattgcatcttttttaccaaacccaactaatttttttgtttctaattcaaaacgagtcactactttaccagcattaccaacttcattttctaagttataaatttttcccatcaaataaactttattcattaaaatacctcctttgcaaagtaggtcatttgacctactttttgctattttctagaactgctgtattgagaatatccattatttctttcattttggttttacaatcttctaataaatcgaatacttttttgtctattacttctccctcagtatcctcaatttgcaaaatttcataattttcatttactttttctatagctttttgcatagatttatacggcttataaatatcttttataaaatcatttatctcataatcaatatttgtttcagtttttttgcgcttagtttccagtttgttttttccttgtaaaaactcataagcattattaactgatatatctccattatctaatttatcttttaactcttgattcccctctttaataactttaatatatttttttgccatagcttcagacataccaaatctagtatgaagtaacgcacgtgttgtaccaactattctttttccgtttacttcagttttgttcttcttagcttcttccactatttctaaataatcttctatctcagcaatattaaagccactacgttgatgaacatttgtttcatgcattctaaatctagttattaactcagattcatctttagatacaacaacacaatttggcatttctaactctttttttaatttctcgctaatttcaatactgttattaaaaatataattaatcgcacttaatctcttgtggcccgtaactattacataaactgatggatcctcggtttcctttacaacgagattttgttccaaaccaatagtagaaatagaaacagctaattcttctacttcttttggatctatctcatactttttatatctgcctatttgaatttgattatatggtatacgtgccagtttatcaccttcaaataacataccatttactacattttccttattttgattactaagtgttttcattagatcaaatttagctgccattatcttaatacctctctctctatctcatctaaaacactctgccattcctgtccaacagttgtattacctttattaaaatctgtgacacaaatgtccttatttttaaacggcttagcttgataatgtatattagtcttaaataactgatctgcatttaactgagcattaatttcttcttcaaaagctctatcatccttattacgagatttttgattaataagcactttatatttaatttccttaccaaatccctcgataacttgatatatctgtgataaagtagttgctacaccatcagcagcccattcatcacaagtagttggtattattacaaaatcacttgctatgaacccgttggttgttaatagtgatggaaaaggattaaagtctaataaaataatatcatattcatcctcaatacattgagttatcttattaattattctcccttgatcacacattgtgttgctcctgactaactgttctgaatttactagggcaagtgacgaaccaataatatctaaattatctgtaacattataaatagccttatgtactttttcacagtcaacttttgcagagaacaaatcagtcatagacaaatactcatctttaaaaacttcatcttttaaaatagtttttgataaattagcttgcggatctgcatctataatacaaattctataaccttttttagaaaaatactgagcaatagttaaaagtgaggttgattttccaacaccgccttttgttgaatacgccataattttttttgatttttttaatttcatttttttctccttttgtactcccttgagtaccctttctattttatatatttattatagcacgttataggtgtattgtctaccttttaattatttttttattatttttgttagttatattggggactacattctaaaagtttctctttttacttcgtaaaaaaacaaaaaataaactacccctagttcccctacgtttattttttttagaaacttttagaatttttttacttaataaaagagatgattatttcatcccttctacactctgcttaactatttttttatacttgtaatatgaagtttttttcatatcaaggatcgttaaagtttcgttaactgtatatattttattttcctgtttttttacaacttctttaaaattatcaggtaaatctaattctggtctcccaaatcttatcccatttgctcttgcaatctcgattccttcagcttgtctttttcgaatattttcacgctcctgatgtgcagtgaagcccaatatctgtaatactagatctgatataaaagttcctaatatatcctttgcaacagtcgtatcaagcaaagtcatacttaaaatcttaatatcggctttctttttctttgttatatatgtccagttttccattatctcagcataattgcgacccaatctatccaattcatgaattacgattaaatctccctctttaatttttcttattaatcgtttgtaattttttctgttaaatgttgctccagaaattacatctatatatatattctcccttctgattccatattctgttaaattttttaattgcctttcataattttgatctttagatgatattctaatataaccatagttcatctttattacctccttttagaaagccattataaacaaaagtaggtcaaatgacctacttaaatattaatctactgaccaaacctaaaaccacatatgtaataacactaccgccacatatactctcctgtggggtttcaagtttattaaataaaaagaggcaaatctaaattttgcccgctttctttttttgatttattgaattgttttctattattttatctctattctcactgtagtaatttttaaaatatttctttttcttatctttagtagctacttctctgcactctgccgaacagtatacaagatggcttttatttacttcgaactttttaccgcatacaggacattgcttatgctctctttttaatttattttgtctaatcaactcatttttttctaaacgttctttatttcttatttcgtaacacatatccgaacaggttattattccatttttagaattaaatttctttccacaaacaatacatttttttatcatataggtatttctccctttttcgctgtacccattacattttattataaatattttgtataacatcgtcgactggttacagtaaattaatattaattcctctttttattcaacatcatcacaaagtagaatccattcaattttacatttaaaatttagaaaattttatcctatcattttaataattaatgaatgttgtaaggaacaccaaacgtaattaataatttattgttatggcttaattttaaagaatgtatttcatcacttttatcagcaaattcagaatcatctaaaatagcttctataatttcttttattttttctgccactctcatataaaaataattatttttatattttataaattcttcatctttttttaatgatttatataattcttcatacaaatcttcagataattcttcatcataattatcatcatcttcttcattaaaaaaaggatactttttactcaaatagtctaatatataataattaatatcatcatttagacagtatacaatactttcagtatttattagcacttgttcgctttctgcaatatgagcaagaatacttctacattctgctattctaatagacataccccaacattccccaaatccatcaaaatcataattaactaaaattgagagatcaatatcacatttatttttaaattcaatgatgcaatcgataagatttttaaattcttgtggtgttttctttattgtatcctctaaatagttaaatatatcttgccttaactctttaaccgctatctccatttttagatttcctttctatctaatttcttaattatttctttataagaaataccatttttaattagatctaaaatagtatttctaaaattgtctggatcatattcatttaaatgcataagtatgtaatcatctgcaaagtcagtagcaattattggtttttgcaacgccattctattatttatataatattccgcctttgtttcttttaaaagaatatgcgataaaacataaaattcaagagcatggtatctcatccgtggataagagtatatatgcatgttgatgttttttctagccttttcaacaaaattattccttatatcattagcccactttacctgcttttcactcccaattaattcaggtaaataatttattgtttccaaaaaattattttgggaagacttaagtatttcttccttttcaatccttaatgcacttttatcctttttcatttcatttcttctcctactattcagcatatatctatttatataatgtgtttatagaataatattttaaaacttaaagcattattttctttcaaaatctatgtctaaatattcaatatcctcaatttccataacatctgcccttcctaaaataaattcaataaaaacacctccataattatataaatgacattttgcaattgtatcattgtattgatttctcaatgatggcgtttttatatattcttcatagcttattacttttatcattttatctacttacctttactttttattaatttgctttctcggagtactttgtttaatttcatatttgctgccatcctttagaccgagttcataagcatcttcactttcatttgtataattagttttgactgttctaattttcatttgtgttttaacataatctactacagctggatgtagatctgttaagatagtaccaaggtgcgacaatagcaagctgccggttctttttttatttacggatacctctgcgtatcctttttttattttatatccggctttaataataaattctaagatgggaatatttagaaaaaaagaaggtcactttatttgaccttcgatttttatgttttatatttcaactgcttctttaactaatgcaactacttcttccatagttccacagttaatagctttagcagctaattcattcatttcagattttttcattgatctgattaactttctttgcgaaagaatagatgtagcagacatagagaattcatctagtcctaaaccgattagtagtggtgcagcaattgcttctccagccatttctccacacatacctgtccatttaccttcggcatgggctgaatcaattacatgtttaactaaacgtaagattgatgggtggaatggttgatataaataagaaaccccagatgacattctatcagcagcaaatgtgtattgaactaaatcgtttgtaccaattgagaagaaatcaacttctttggcaaattgatcagctaacactgctgcagctggaatttcaatcatgatacctacttgtaatgtatcagatacttcgattccttcactaattaatttttctttttcttccattaagattcctttagcttttctaaattcatctaaagtagcaatcattgggaacataattcttaaatcaccatatactgaagctctaagtaatgctcttaattgaactctaaagatgtcttctctttggaaacataaacgaaccgctctaactcctaagaatggattcatctctttaggtaaatcaattgcttcgatttctttatctccaccaatatctaaagtacgaacaacagcaggttttccttctaatccttcaagaacctctttataaacattgaattgttcttcttcagttggtaattgagcagattccatatataagaattcagttctgaataacccaactccttcaccaccattgtctagtacaccttggatgtcttttggagatccaatattagcaactagttcgacgtgatgatcatctagagtaacagatttttcatttttcattttctttaattcttccttgtatgcgatgaatgcttcacgtttagcttgatattctttaatttcatcatcactaggattaataattacaataccagcttcaccatctaaaacaaccatatcagcatcattagtttcatcagttattgttttacaagaaacaaccgcaggaatttctaatgaacgcgccatgattgctgagtgagaagttctaccaccaatattagtagcaaatcctctaactaagtttttatttaattgcgcagtatcagatggagttaagtcatcagcaataataacaacttcttcatcgattaaagcaggatttggcaatgacttacctagtaagttagctaataaacgacgagatacgtccttgatatcagccgctctttctctaaaataatcatcatccatactttcaaacattgcaataaaagtattagcaacttcatctagagcagcatcagcgttaatcttttcatttctgattttatcctctacttgagtttttaattcaggatcttgtaatactaatgcatgagcatcaaatacagcagcttcttctgcagataagtttttagcagcagcttccttaattgattctaattcttttgcagtttgtgacattgcatcgtcaaattttttgatttctgcctcagcatcttctactgttacttttgtcactgttaaatccggcattactagtttgtatgctttagcaatcgcgataccactagatgccccaataccttttatcatattaaaaacacctccatatacattcctattttaccttatttttagcaaaaaataaagaaatatcgaactgtgactaggtattttcgcgttatgaaaaaagggctttcaaaagggacttacaaattaatagactttgacaaaaaatacatgactcgtttttttcgagttttgaaaaatgattgatatttccggcctttaacttgaagttttaaggtaaaaatagtatcatataagtggagggacacaaaatgaaattaattatagttgaaaattatgaagaagcaagcattgaagctgcaaaagttatgttagaagttgttaaaaacaatccaactgctaatttgggattggctacgggatctacaccaatcagaatgtatgaattgatgatcgaagatcacaagaagaacgggacttcttataaagatatcaaatcatttaacttagatgaatattttggattagaagctactcatccacaaagttatcattattttatgaataaacatttattctctggaattgacattaattctgaaaatgtacatgtaccaaatggtgctggagatattcaagtaagttgtgatgattacaataaattattagctgaaaatcctatcgatatccaattgttaggaattggttcaaatggacatattggttttaatgaaccaggaacttcttttgattcagtaactcatatgattgaattaaaagaaagtacacgtcaagataatgcccgtttattctttgatgggaaaattgatgaagtacctactcatgcgattactatgggaatttcaaatattttacaagctaaaaaagtattattagttgcgtgtggtgaaaataaagctcaaccaatcaaagtattggttgaaggtgaaaaaactacagacgtaccagcaagtgcacttcaagatcataatgatgttgttgtaattgttgataaagcagctgctagtttattaactaaataataaaaggaaagatttataaatctttccttttttaaaaccttttttttacctttaaagaaatgtgtttaatttgtttacgtaagataaataacgtataattattatatgggggtactaaatatgacaaaaaatttatttaaagaagtagcgatgaatgaaacaaatccaaactactcaaaagcaatatcaagacttgaaccattgtatcaaagaagtaatgatctacgtagtgagtttggtcgtgattatacgagaattatcttttctcaggcataccgacgtttaaaacataagacacaggtgttttttgcagttaaggatgatcatgtttgtacacgtagtgaacatgttaacttagttgaatctgtaagttatacaattgcaaattacttaggtttgaatactgaattaactaaagcaatagcagtaggccatgatttaggacatgccccatttggtcatggtggtgaacgtattattaacgagcttgctaaaatacatgggctcgattctttttggcatgagcgcaatagtcttcatctcattgatgaaatagaaacattagaagataatgaacatcatcgccataatttaaatttgacatatgctattcgtgatggaattatttctcattgtggagaaatgaatcaaatgagtattaaaaagcgagatgagtatattgatttacaaaattatactagcccaggacaatacagtccttatacttgggaaggatgtgttgtaaaaatggcagataagattgcctatttagcacgtgatattgaagacgctttacgtctcaaggtactaaaagagaataaagttgaagtcttgaaagcttcgctcaataatattactagtgaatatcattttacagcaatcaataatggaactgtcgttaattattttattcaagatgtatgcagtcatagtaatccaagcgatggaatttcattatcaaaagaagcttttgaaataatgaaaacaattatgaagtttaattatcaaaatatatatttaattgatagagtacaaattcatactaattatgttaaattgattttaaattctatttttgatttctttattaaatacgatttaatggctcgagatagtaatactaatattattgatgaaatttctaaggataaagatcaatttccccatgcaatcaatggatttatccattggcttgaaaaatatagtgtgatgaatggagcaaaacgtgattcgctttatcaaaataaagttatttatgattttattaatgatgataaagcaattattaaaagcattttagattatttatcaggaatgtcagatgcctatattattcaaatatttaatgagcttatttcattttaatccattgaagaaattcaatggatttattatttttacttaaattattagaatagatgtggtaaactaatcattattagggaggtttaaatatgcctattaaaataccaaatgatttaccagcaagtaaaatattaaaagaagaaaatatctttgtgatggatgaaaatcgtgctttagctcaacaaattaggccattgcaattattaattttaaatattatgccgactaaagtagtaactgaaacacagcttttaaggatgctgtcgaatacaccacttcaaatcgaggtagactggattcatatggccagtcatgaatctaaaaacacacctcaagaacacttattagctttttataagacatttgaggaaataaaagataataaatatgatggtttgattattactggagcaccggtggaaaaacttaggtttgaagatgttgattactggttagagatggaaaagattttagaatggtcaaaaactcatgtatttagctcattttttatttgttgggcttctcaagcagcattgcattatttttatggtattgagaaacatgaattaaaagaaaaactgacaggtgtttattttcatcatactaatgttgataaaatgaagcgaaagatacttagaggctttgattatcaattttatgctcctcattcacgttatacaacaattatggcagaagatatagcaacgatttctagtcttgatattttagctgctagcgatgaagcaggggtttatttgattgcagaaaaagatggctcacgtttttttgtaactggtcatcctgagtatgatcctgatacattagataaagaatataatcgtgatctggcaatttctgatcaagctactatgcctaaaaattattataaaaatgatgatatgcacaatgaaattttagtaaaatggcgttctcatgcttatttattatttagtaattggttaaattattacgtttatcaagaaactccatatgatttaaatgagttagaaagtttaaaactaggtaaataatgtaatattgtatttacgataagtttaaaagttgaagaaataaatcttgctcaaattaagtaaatcttctaagttggaccagcaaatgatatgtatcaagaattctagacacatatcatttttggtccaatttttagaatcggtacaatttgagtaatcagtaaatttatatataatttctaaataatgcagtagaattaagtttctatttcttttaagagtttactttgagtttgtctgtatcttagtggtgtaaggcccattgtttttttgaatattttatcaaaatattcaatattattaaatccacattcaaaagctatatttagaattgataattcagtagataaaaggagttctattgccttatctattttttttatttaaatattggctaggagtcatatttaaatattcatgaaattttttaattgtatattgtttagaatatggtgagatgataaaaatatcttttgtttctttaattttatttaaatcttgtatttctaataataatgatttaaaccaatttggatatatattcgtatcttttgattgatgatagattaattcttttatcatttgatataagaacaattctatatctttatttaactcataataagaatcgttgagattgatatcattatagtaattaattagttttctagatttttcatcagataagtgtcctattacagtatcattaattaaatgaaaacctccaaatatagtctgaactctattcataattttgtcagaaaaagctaaattgatatattttaaggaaatattttcattaatagtaacaagttcatgaaaaatattttttttcattaaaataatgttatttcataatatgtctgataatgttttcctacttcagatttttttctttttcggtgttgccagtgaatatctttgctgttattgatgatttctagacttagttcttgcataaagcacctccattatttttattatattataattttgatttaaataaaattaaaaataaagttagaaaaataagataaaatgaatgctttgtttaataaagtttaaaaagcgaatatatgttaagtatgatataccttgttatgatactctttatatgaaaaggaggtagacaaatgaatgaaattcaatatttaaaagagtttacgagattgtataaagaaaatagtcatgataaatacaatcgggaagtagaatgccatttctttatgcacaaggaaaatcgtacaaaaataacgagcgatgattatttcttatcatgttttcctagtgcaatttgtggttttggatcaagaaatactaactttatttacaattgcaaattagaacgattagcaaaattaatcgaaggtacacatgatgttgaaaaagaagaattagaagaattgtatacgttttgggctgatgagaatgataaagaacgtcttagaagatattatccaaatgatataaaagaattaatgccatatgatgattttgaaaatgattattatacagcgtatcctttatatagattaggaggagcttatcttgattttgaaaaattatttgatttaggaatagatggattgattcatgaaattgattcccaaccactcaatagttttttaagagcttgtaagaaatcgcttatttacttaaaagaattaataaaactgtatcatgatgatgccatggacattaatcctgaattggcttatacgttaaatgaattacttgaacatagaccacaaaatatgaaagaagcgattcaattaatgtggatttatgtaggcgttagtgaaattagaaactatggaagaatggataatcaattagcacgttttttagatgatgaacaagatgcatataagaatattgcagaatatttcaaggtaattagacaacgaaatacgatttacaatggtcgtattattttaggtggagagggtcgtcatgatcttgaaaaagcaaacaagatatgcagtatagctcttaaagttatgaaagatttacatttaactgaaccacaattaacacttaggtggtcaaaagatatgcctgatagtatttttgataatgcgattgattgtatagaaagtggttgtagttatccattattatacaatgacacggttaatattaaaaatgtcaaagaatcaatgaatgtatcatataaagaagcggttgattatgttcctcttggttgtggtgaatatgttttggatcataaaagcattggttcacctaatggaatcattaatttagctaaggtattagaggggttggttaatgatggaaaatgtatgattactaataaaaaaatagtaaagcattatttaactaaagaacctaatacatttgaagaattatatgatgtatataaacaagagttagattatcaaattgatttgttagctaaacaagagaaatttgaatatgattatatgaataatcattgtggatacttatttaattctattctttatgataactgtattgatagaggtaaaagcttattaaatggtgggattgactatctaggtggaactttggaaacctatggtaatgtgaatagcggagatagtttatatgccataaaaaaattagtctttgatgataaagaaattcgttataaagatatggttgatgcaattagaaataactttattggatatgaagagattagagaaaaatgccttaatgttatcaagtatggtaatgataatcctgaagtagatgaaatgattaatgaattaaatcagtatgttgcagtcacaacaaaatctaaatcagaaaaatatggattatcttcatatttgatagttattataattaaatatccatttacacgaggatgttttaccaatggcttcaacattaggataattagggtcgtacttactaaataaaataaagagtcttaaagtataagattatgatagtttcatcagtagttttgaactgtaagagaagattaaaatctatacttacctaacaccagtgatagttttcttttgctttgtatcaaatattgccttgaatttatcaatattcataatatgtaaccactctagatatagtatagttgtctagtctgatatagttaaaccgttatgctgatttgttaacatttttagacaaagaaaaagaactaagtatgaactgaatttcaaaagttggacagtttataaatagttctttttatgattaatctgttgtccaatagttattacttcaaaaattccaatgagaaagaagtttatttcatgaatcttctaacgattttacatcatttttattattttgcttattaaattctcacatcattatgataaaataatcctctataaaatgccttaatcttctaaaaaatggaacattatgttaattttattaataataaaatatcgttacaaaagtattagtatttatctatctggatttttgtgattgaaaaaaagtagatatcatttcctgatacatatataatactatttgtgaaggtttgactgtatttttttgtattttacagtaaaaaagtactaagaaataatgcttagatttgaaacgtttgaaagaaaagttttaaaaaaatcaaaagaagaaatcaatgaaaagtcaaacgtacatatgagccataaaaatgaaaaccagtcattcaataactttgattttatttacgtttaattggtagtcaaaagctgatgtcatagatgttaaaacagaagtacatcaggaaccaatgaactgccctgaacaaatggaactggaagaatttttaaaggagtttgagtaacgtggttatattaaaagacaaaatgaagatcagtactgaaaagaacctcaaagaatatgaaacgcttctacaagctcttaaatgctcaaacacgctccaaacaaagaacaacgaaacaaggactgtgagtacgcaataaaaaaagaacagatactaagcaatctaaagcattacaaaaaagtccgtaatgtattttacgaacttttttgtaccaaatgttcttgaaccgctgaactattagaagtgaaaaaagataagtagtcgagagatttttttagattttcgaaagtataaaaaactatacataccaacagtttcaaacgaaaaaactatagctgtaaccataggaataatgaaagcatgtgattttttcacataacgagagagggtggtctaggcgcgagaaccctagaccaccctctcgaaaaacgtcgatacaataggctaaaacaatgaaatcatagcgttaaaaagtcgtgccactgtggtacaactttttacttataaatacgtataaataatacccacttattatacctttttttgattatgcaattgttagaaactgtttttattaacaagttattattttgataatgctatataaataatatattttgacaatgttataaatgataacattgttttattctataataaatcgactctgatactttgtaggtgcaccatatgaagagagatacgtccatgatccgccatattgtggttttctgtatacgtcatatctttgaactttataatttcttgctacttttaattttacagctttacctacttgagttgatgatatgcctacaaatactccaccactagaacctgataccacaccaggagaatatgctacgtcaacagataaatattttccagcaatactaatccctaaagaccatgttcctggacttcttgaactatcactccaatagaaaccgctattttccgaattaaaaatagtacctcctgctggttgatcataagcatttttatatggtgaaaatgaagatgtttgagggtcaccaacttttctataatcataagcatatgattcttttgtccgctcaaaataagctttcatttttgcaatttctatttcttcagctgctctaaattcttcttctgttggggtatatataataatattgctattatcagtactttctaatgcagaaatattggaaacaggaatacaaacaaaaatcattagtagagcgattataattttaatagatttcataactttttcatctcgcatataatttaaatatttattatagcattatcttatataaatattgtaatataaactagcacatttttctatataaagtcaaaaaaatatgattataaggttattatttgatttatcgttatataacgtagtataatttttttgtaggaggaatagatatgaaaaataaatacaaaataattgttatagtggtaatagtatttcttctttcgtctttttatttcggatactcattaggaatagatgcagataaacctaatgtaattaataaaatatcaggaacatatcaattatttaaaggtaatgaaacattaacagtaacaattgatgatcaagataatctttattaccaaaatggatttgaaaatgaaagtattaaaataaaaacacaaataaataaattatacgaaaatttatatttatttgaaaatgagaagctaagttataatttaatcttatttaatgataattttttattgcttataaatattaatgatcaaacatacgacaaattagaaaaagtttcgaacacacaagtttttttataaaaaagaagaggtataccctataattttgtaatttaaatatatatattttctcattattaataatgttgatttattaaagtattaaaagtctaatatggctgtttactgctttaaggatatgaatatgggggatattagtagattttactaaacattacaattatattaattaaatatgaaaaccttaatttgtcagttaaaagtaaataattaatgtttgagtgtgtagttcagttgaattacgcacttttaaattttataatcgttttagaatcagtttaattattaatgatgtgttaataattaaattaaaggcagttgaggtgagaatgatgaatgcaggaaacaggatatatatggctaatctgcattaactaatacgttacaccataaaaccccgatcgcacctgcgatagtcaaaggcatgaatgtttggaacgcatttttaattgcagataaatacttattttgcccacaccacgcaccaacgcggccaaggacatctgccattttgtccataattcttttcctcccttattgactacctaataatagcaaagggtgaaatacttggaaacgctttccccacattctgtaagagtcttacaatttttttaaaatatttaaaaatgatatgtaaatttattacatatcatgatctgtctttttttcatatttttgttcacaatttatctttctaattaagttaggataatagtctttttgaaataagattgaaaagattagatccattaaataatcactacttaactttgaagaataggtttctattttcgaaacaatattttctttactacacattgttaagcaataattcgcccgttttcttaaataactatcatttattgaagtaattgcaataatagttcccttattatccacaatccgatcaactatcgtttttatttcatgactctcaccagaataagatatcacgattgcaactgtatttttatttacaaataaagaacgcttatcttgatcatttggtgaagatttaaaattaacaaagtgatcgatcgaaatcatccgatgctcgaataatagtcccgaaagatacgaagctccaacagcaaaaatatcaataactgatgtttttaataacttttcaattacttgattaagtacatcatagtcgagtaatgctttagtcgcctcaatcgtatctttatataactcgcctaactgatttgtgacttcttgaatactatcattctctttaaaaggtcgattgtaatcaacatcagtttgataactagttaaaactgatgaagcaaaattgatcttaaagctattgtagtttttttcacccagtttcttgcaaaaacgactgatcgtcgctgttgaagtaaaagtcgcctcagctaactcaactaaacgcatattagccacttcttctttatgatcaattatataattagcaatccctttttcaatgtcactaaatccttttttgtattccagttttgataataaactcataaactacccccgaattactttataaatattgtcccaaatttttttccattataacactaataagggcatgttagtcttttttaacactattttaacactattcttttttgatttttctaaaataaaaaagcccttttggacttttcatcatttagattaaatagtcactaaattaaaatatgaactgtcaatagatatcttatgagagtagcgactatttctacaagccaactagcctgtggaaatataatactccattgttttataaaaaaatataaatttatataattcaggatagtattttcaaaattagcaattttaaatattaaattatgaaaattttttacataatttattttttattttcaaagtcaattacttttaaagcagtagtaacattactttgataatcctttacaagtaaagacacaaaaatgacatctagaacatacattgttgcagtaaatgatgtaatcacttctaaactaaggatatcttgtgacgagtaaacattgaggtaaatatcacaatagttttgtaattcaccctttttaccaccaattgcaataacatagattcctgccttttttaaatatttagcaatcttgatcatctcactattattgccagtaaaagaaataagtatggctacacattgacgactatttttttgtgataaaatgaaatgttcgttgattccactatgtgcatcgcactcttttcctaaagtcatgattttaaaagcagcttgactggcaatcgtataactaattcctgttccataaatagaaatacgtttagcttgagataaacgattaatcacctgaatcattttattttgatctaaatccagccttgtctgtactattgatttatcataaatagttgggataactttaacaatatcttgatatgtactgttttcatcaaccggttcatcttttaaaagactactaattcgacttaattcattatactcaaattcaacctggcgtttaaattcttgataactattaacccccagctttttacaaagacgtattactgtagccttactcgtataagtttcttttcctaattcttccactgataattgatataactgttcaggatgttttaaaacatactctgcaattagcttttcgctattagtaaagcgtttcctctcccttagcttctctaagatcatcactatcacctcatcttttcctattatgacatagatatcaagatgaaacaaatttgaactaatcaattatctttttattaattaaaataaaggagattgaaaatcctcctccattttacaaaacagctaaatatcatttaaactttcaccgttcgttgcaataactttttgataccaccaaaaactcttcttgggataacgcgccaacgttccactaaaatcatcatgcacatcaacataaatatagccataacgtttagatacttgacattttgtattagcaacaatatcgattggaccccaacttgtataaccgagtacttctacaccatctttgattgcttctaaaacctgctttaaatgctcttttaaataatcaatacgataatcatcatttactgtataaccatattgttcatctacaaccaaaatatcctttgctccaagaccattttcaacaataaataacggaagctgatatcgatcataaaattgattaagaatatatcgcaaccctttaggatcaatctgccaaccccattcagattcttttaaatagggatttttaactccgctcattacatttccccgagcttgttgattaagtttctcatcagctgtagcacaataactcatataataactaaaagaaataaaatcgactgtattttttaaaatttcttcatcttctttcgtgatttctaaatgaatatgattttcttcaaaaaaacgtagcatgtatcctggatattttcccctaacatggacgtcagcaaagaatagtgactcccgatcacgtcggactgtttcctgaatatcttcaggctgcggggtcaatggatagattggactccctgcaatcatacaaccaattttaaaattcggattgattttatgagctatttttgttgcttgagcacttgcaacaaactggtgatgaattgcctgatataaaacttcgagattaatttcatcagcttttcctttaatcccaccaccattaaagggggcatgaagaataacatttatttcattgaatgttagccagtacttaaccttattacaataacgttcaaaacatacttgagcaaagttaagataaaaatcaattactttacgattcacccatcctccataattagtcgctagatataaaggcatctcgtaatgtgataatgtaactaggggttgtattccatatttagctaattcatcaaaaacatcatcgtaaaactgtaaacccttttcattaggaaccgtctcatcaccatgcgggaaaatacggctccatgctatcgataagcgtaatactttaaatcccatctgagcgaacaatgcaatatcttctttatagcgatgataaaagtcaattgcatttttctttaaataattatctaatggcggaattgcttcattaccaaataccccttcaggcaaagcatcagccgttgaataacctttgccatcttctaagactgcgccttcacactgattagccgctattgcaccaccccataaaaatcctttaggaaaatttttttctaccatcttcatgactacacctcttgcaatttatttagtgcaaaagtcaataccgcttttccatccatcttgccataatcgcgcatatctattaaatatgctggtactccattagcatcatccgcaatacttttttctagataacgcacctgtggtcctaaaagaataacatctgcatcttggctgtgattttttacttctgttgctccgactgcccagatttttgtttcaattcctttttcctgtgctgcttgttccatttttgtaactaatagactagttgacattccaccagcacaacataataaaattcttatcattttaattttcctccatctcatcaattctttcaattttaaaaattactggtcttgtcccatcactacaacaagcaatcatcatcttttcatcattagtccagcctttcataattgagccaccttgcaaagctgcataaatatagcgactgacggcatcccaagcctcactgcaaaactttccattcatcatattccaaaaatcatctttgccattaccacgctccaaaataaattcctgtccctctttaaacaatggacatttaccaacttgcggatccgctaaatattgatccgctaaatcttgataatactctcttcttaataccgtaattttacacttagacatctgtttgctcctttcaaatccttttttctacacttttaatttaacatcagaaaataaaagaaacaacaggctcgtaaactgttgttccagtgtttcatttatatattatttttataatttattttgatacttgtggtccactaaaggcattttttaatcgttctaaagcttcttttaagacccaagtagggcaagcgatattaattctttcaaatccttctccttcttgaccgaagacatatccctcatctaaatatagatcagcagcaatcatcctcttctctaattctagatagtcataacctaaatttctaaagtctagccaagctaaatatgttccttctaatggatatactgtaactgatggaagatttttcttgataaagtctaccagtatgtcatagttatgatgaatcaatgtcttaaattcagctaaccatgcatctcctttagtataagctaatcgtgttgcttcaaaagataatgtgtttaatgtaaaaaatccttttttctcttgttgcgcaataaatttagctcttaattctttattcttaataataatattagatccttgcaaacctgcaatattaaaacttttacttggtgctgtacatgttacagtaatatctccaatcacttcacttaaaacagcaattggataatgtgtataccccggcatagttaaatctccatgaatctcatcactaagaattataattccattatttaagcaaatatccgcaattttttctagctcttcttttgtccatacacgccctacaggattatgaggattacaaagaatcaataactttgtatttgcttgttttgcaagttcttcaaatttatcaaaatcaatttggtaactattttcatgatttattaaaggacatctttgtactcgacgattatttaactcaattgcccgatagaaaggataataaactggcgtaaaaataattactccgtcattttcttcagtaaatgcagttaccccatcgcttaacgctggtactacaccattagataaaacgatccattctttttcaacttgataattgtgtttatcattcatccagttaattactgcatcgtaataagctgctgttccatttgtatagccaaatacaggattattctgcataaattcaagcatcccttcagcaatctctggtgctaatttcaaatctaaatcagcgactgaaagtggagctatatttttagcaactgcaggattatgatctttcatcccgttccatttagcagaaccattttgactccgatcaactaatgtttcaaaatcatatttcatttctctacctccattattaagtacctatatagttaagtaccttaataatagtatactctcacaatttataaagtcaaataaaaagaatcataacgattcttcattgtcttgtgcatattctttatttaaagctctttgaaccttaatataaatatctatttcttcattgctaaaactaattaaattcttaaaataacgtttcataattttcttatcaaactgaccatgtaaatcaaaaatctgcctcccgccaaccgttaagtataaattatactcacgattattatgaggattcttggttcttgaaattaatcctttttgttctagcttctttaaaatttgactgctggcacttaatgttttttttaattctttagcaatcatcgaagcatttattccagggtgatttccaattattgcaagagtgtgagtttctactggataaagcatcactttgccaaattgtcgaggtttactatcatattcttgtattaaatcataactttcgtcaattactttaatcatattatcaaatcgctcttgatccacaaaaatcacctcaggtatcattctatcaaataataaccaatgttgcaaacaatcataaaaagactggttttaccagtctttaaaggattacattaaatgtgattctttggttgtgtattcttgaactactttttgaatcttttgtggagtttctggttctaatggataccagcctttagaatacataagatcaaagacctcacgttgaatctgatatacctctttttgaatatctattaatttatttgctagttgttgatgagagcattcaatgataaaagtcgtataatcacttaataatgattttaaacataatagaacatcattgattctatcataatcattaaacgtattttcatttggtaaaattggttgtttcgttggatttgaataattttgattatccatttaaacaccccaataattcactataatgatttttaattgtgctattaacacgtcctaaagtcatcttaatatcattatcttcaacactttcttcgtaagcttttaacttcttcgataatacatataaactattcaattgatcattaaaagagccactatctttagtagatatcatttttggtggttgattcataaaattcctccttcaataatattttggttcttttataaaacaactatgcataatcatatacaaaagattaaaataaaaatattttttattttctacttataaatttttcaaatctgactaatactagagtatctttattaaaaaataaaaaacattattatcttcaataatgtttctttaccaaattaacagccctaaatttttatcctgctacttttattttattttcaatatatgccattactgcttctttagggatatttaataccgctgcaaattcttgatgcagtagatcttctgcttcttttttgtaccgctcatcagtttgactcaatcgcttattttgtaacaataaatttttttgctttgcttgaagattacaaatcaattgaatcaagccatcacaagtatattgacttatcgtttctttgtaataatctgttaattgtcttaaattttgattttcaataatctctttttgtactttaggatgtctggtcaataatcgttctaactcctctatcgaaatcaaatgacgcatatatacttgcgtatcaattggcacatacgtcttaccgtccataaaaataggatttaaagtataatactttcgggaattgggctgcttaccaatactaattactccaatattttcaatcctacaaacactttgattaccatatataatcaaatctcctttttcatacacataaccacctagctttctattaagtatatgcttaatatatctattataccgcactattagttactatatgcaaaagtaattaaaatatactaaattttcttttttatgcagctaaagactacatctttttatatttgattttactatttaaatcttgttaataatttcaacagttttacatgtttcgtatatcattagggcttgctttagcaatgatggtgacagtattttttagctaaaaacctttattgttgtaatatcgttaatccaactagaatttgttaaaacagtaagatagattgaccatcgtttaattggtatttcactttccattcaatattttattcctaatgaagatactattttagttgaaatattattaggtacttcggtttatttttaccagaatataaatataaataaattatcaatattgacagtgcgctaaatatatcgatcgatggttcttttagatactaaaacagcaatagaaaatcaacttattagtttaatcagtgaaatatttatttcatgaccaaactaatattatctactaactaaaaaatgcagaccattgtttgcctacattttttgtgcatattcttttactattttagaaatcaaatttaacaaagcttcttcgtcattaacttcataatcaggtttaatatccattgctttaagtccctttttatttaaccaaatacatttccaattagcatttttggccccaatcacatcattttcataagaatcaccgacatagatacaatctttatccgtaattaaattaaatatctgtggatctggttttgaataaccaacaaccgatgaaatgtagatatcctcgagagcaacccagttgctcatctttagtctacgtaatttttccatttgatgacaagcaggtccattagtaattatccctattcctatatgattatcttttaataaatctaatatatctttgattgcattactagttgtaatgtcttgttgatatacataatattttttttgaaatgctaaagcatgtgcttcatcaatttcaagataatattcttttaaggctgcttggatacgatagatatacatttcatttattgtaacttgaccagactggcttgcctcaaatattttatcactatatttacgaaatttgataaaaatttgatatataggcaaagtctttattttaggaaatatttcaataaatgcctttttaaatggaatgaactgatcatatagcgtgtcatcaacatcaaaatagaatttcatctttttaccgtttataatttattaatcatttttacaacattatctactgtaaaaccatatcttttaaacagttcatcagcaggtgctgaagctccgaagctatccattgttatatatttgccttttaagccaacaaactctccccaggacattcttgaacccgcttcaattgcgattctcttttctatacctggcggcaggatactttctctatattcccggctctgctgtttaaatatatccatactcggcatacttactacccttatcgctttgcctctgatccgtttctttgcttctactgccaatgtcacttctgatcctgaggctatgatgattatttccggtgttccttcacactcatcaataacatatcctccttttaatgcttctcggctagatcctttgatctgtggtagattttgtcttgataaaaccagtgctgttggtgttgtttttgatgtcatcgccagataccatccagcattagtctcctgtgcatcgcacggtctaaacacattgaagttcggcatcgctctcagcatcgtcagctgttctaccggttcatgagttggcccgtcttcacctacaccgatactgtcatgcgtcaatacatatatcaatggcagattcatcaaagctgacaatctagccatcggtttgacatagtcgctgaatacaaagaacgttgatacaaaagtcttcaatccaccataaagcattattccgtttccaatccctgtcatcgcctgctctcttactccgtagtgtaaattccttcccctgtaattctcggcactaaagtctcctactttatttaaatatgtttttgtagatggtgctaagtctgctgaaccacccatgaaatttggaaatagttcctttatccggttcatcgcagttcccgacaaatttcttgttgattcaggtttattttcaaatttccagaattccacatcgttttcaagtactttattatagtccacctcaaaatactgcttccataattttttcatctctggatatgttaccagatagtcatcaaacatatccttccaaatcttatagattacctcgctgcgttcctgctgttttgctgtattgagataaacttcctcatctatcgcaaatgtcctatcctcatcaagtcccagtgtcctttttaattccctgacattttcttcacccagcggctctccatgtgcactggcttttccctctttagccggacatccttttccaattctggttttcacttcaataaaggccggcttttgagataccctagcttgatttatcgcacttaatatttcgtcaagatcgtctccatcttcaaccgtgaatgtatcaaaaccaaatgccttcattcttccctgaacatcttctctaaaggcaatatccgtgcttccttcaatcgaaatattatttgaatcgtataaaacgatcagtttctccagttttaaagtgcctgcaagtgaaaatgcctctgacgagattccttccatcagacagccgtcaccgcctagtacataagtaaagctgtcaaatactggatatcccggtctattaaaaatcgctgccaagtgtgcctgggccattgccattcctgttgccatcgccatccctgctcccaatggtcctgtcgttgcctcgacccctacagtatgtccgtattcaggatgccccggagtcagtgaatcaagctgtctaaactgtcttagatcctctatcgttaatccatagttatacaaatgaagcagactataaagcagtgatgatccatgtcctcccgacaagataaagcgatcccggttgacccacttccgatgtgttccactatgtttcatgacctttccccataagatataggccgccgccgctgaacccaaaggcagtcccggatgtcctgaatttgccttttcaacagtatcagcgcataatgctctaatggtactgactgttttgaggtttttcattatcactccgctaaagctttttgagacccccagcctagctgggggttttattgcagacaaaaaaggatttcacatatgtgaaatccccattaactatagttataattaagctttaccaatgcaaccaaagatttccattttttctttaacacattcttggatagctgcagcacctggtgccaataatttacgagggtcaaatcctttaccttctaaatcttttccagcttcaatgtattttcttgttgcttcttggaaatataattgacattcagtatttacattgattttagaaacacctaaagtaattgcttttttaatcatatcctctggaattccagttccaccatgtaatactaatggtaatttatcagtttctttttgaattgcatctaatgcatcaaaatctaaaccttcccaattttctggatatttaccatgaatgtttccaatacctgctgctaagaagtcaactcctaagtcagcgatcattttacattcttttggatcagctacttcacctttaccaacgacaccgtcttcttctccaccaattgatccaacttctgcttctacagatacaccttttgagtgacataattcaacgatttcttttgttttttcaatattttcttcaattccataatgagaaccatcgaacatgattgaagagaaaccagcttctaaagcagctttagctccttcatagctaccatgatctaaatgtaaagctactggtacagtaattcctaaagaatctaccattgctgataccattgctgatacagttttgaatccagtcatatatttagcagcaccttcagatactcctaagattactggagcttttaattcttctgcagttaaaagaatagattttgtccattctaagttgttgatgttaaattgaccaactgcataatgtccttcttttgctttatttaacatttctgttgctgatactaatcccataaaatttctccttttctttttactcctatatattactattatttaattgaaatttccatagtaacacaaagtttttttgcctatttcctatatttttaccccattatctgagtcgtaagcgatttcttttttagaaaataaagaaaatgcagcatcaatgatgctacatcactaaaaaatagatatacacgatgaatagcagtgggaaacttgttgctactggcgggacataacatcaactacattttctccttatctataaaagattgaattattaaactatttggagaacaattaaaaaatcaatctctaaagataacatattaaatctgcgctcattatatcaaacaaggtttgatacggttttattatattacattttattattatgtcaataataatttattataaacaaaaaaataaaagaccaccaccggtgatctttatattagctgtctattctttaacgcttgatataaattatctagagcctgcactaataaacagcgcggcatcgctaaattaaatctctcaaaacctgctccaccaacaccaaaaatatatccttcatcaagccataatttagcttcattgaccataaatgcttctaattcctcgtgcgtcatttgcaaagcactaaaatcaacccaaacaagatataacccctgaggtttaatcattttgagcattggtagttttttctttaaaaaaccatcaagatatttaatattgccatcaagataagccactaattcatcaacccacttatcaccatgattataagctgctttacacgcttcaataccaaaaattgttggttccaccggaaatcctagtgaacttttaaccttaataaacttttcttttaatttatgattaaaaaataatatattagacgtctgtaaacccgccagattgaaagtcttacttggtgctgtacaaataattgtaaattctttaaatgaggcatcaacattaacaaaaggaaggtgcttattccccttataaataaaatcttgatgaatttcatcactgactaccagtacattatgtttcttacaaatattacctaatttaaataattcttctttattccaaacttttcctattggattatacggattacataaaataaacattttcacatcattatcaataatcaactgctcaaacaaatcaaaatctagttcgtatgtttgaccagtaaacatcatcggacattcaattttcttacgttgattttcatcaatagaaaaatcaaatggataatacactggtttattaatgataatagcatcaccgggagctgtaaaagcattaactgcgattttaagcgctgttactacccccgttgttgttacaatattatctgcatttatatctaattgatggcgacgcttcatccaattacaaaccgcctcataataatcatcgccagccattgaatacccatacactgcatgtttagcgcgttcaataattgcctcagtaacttctggcaaggtttcaaaatccatatcagcaacccataaaggtaaaatatctttcggttttccttcttttttccaagtatcccatttaatacattttgtatttctacgtttgactattttatcaaaatcatacattcttacaatctccttataatccacttattatcgcaatacctgtttatctttgaattccatcattgaaaagtggcataacgtgattcctaatgccatggataaatttagtgagtcaattttatcactatgagggataaatacactttgcccatattttaaataatcatctggcagtccgctgctctcattaccaaaaaccaatgaatgtttattatttgcagcagtaatctgatgaatatttttagctccttttaacatcaatggatagacttcacgttcagggtatttagttagatattcatcaaaactattaaaatattcaaaattaatattaaacaaagcccccatcgatgccctaattactcgtggatcaaaaacatcgactccaggacgaataatcgctaaattagtataattaaaacctaacatagttctaataatcgtccccatatttcccatatctccgggattaactaaaacaacatgattagcatcttctaaatccatcgtatatttcttaatgattgcaatagcaaaacaattatcttttttcgctaatttattaattgtattatcactttcaattaattcaattttattttgttgacataaattctcaataatcttaacacccttattttgataagagttacttttgagataaacacgcatcaccaattctggtttattctctaataattcaatcgtttcaaaaaccccaagagtatatgtataatcaaaatctttatgatatgtttttattttcattttataaacctttcaataaatcaatttgctttttcaaatcctgctgcattgataaaaaatgtgctttatcaaaatcaacaccttgatcaattaaatctaaaagatcattatatttatcatatgctaattctaataacgagatttgaatttctaaatctaactcattattagcatcatttacaatttgattaatatctttatatttatctttaaatacctgttgcaaatcaactgtctttttcttcttaccaaacaatcccatttcaactacctccattgttatttttataattatagcgtgtttacttagttttgaaaagtttgttatttttaaattgagagatgtttatataacttcccgaaaggaatcactggtgctggtttgcctggatgctctcctaacattttttccatccagatcatgtcatgccattgattaaacttatagccgcatttagtaaaataagccaccttttgataaccaaaatgttcatgaaacacaatactttctggattcccagcagtaatacaagcatttaaattaataatattttgctgtttcgtaatttcttctaatttatggtataacatactgccaattcctccacctttataatcaaggtcaatataaatcgatgtttctacagcccactgatatgcagcccgacttttaaatgcggatgtataagcatagcctactatcttatcatcaagcttagcaacaagatacggatacttttctaaagttgaaacaattcttgccctaaattcttctaaagttggtacttcatattcaaatgtgattgctgttgttagtacataaggtcgatatatttccaataaccttgcagcatcatcagctgttgcaacagcaagcctaattttcgtcattgataattcctccatttttctaagataaactgtataatcatgatataataatactaactttatcaaaggagaatagcaatggataaaataaaagatttatatcaagatgacctaatctacattttcactcgttcacaattacgtgacttaaacactgattacttggcaatcattaaaaatgaatgttctattcagacaatcaataactgcataacaatgcactatcaagatgatttcgaatcattattagctttttctctaccgactaaaaacagaaaaaacaagcagttaatttctttaaatcaatgctataaaatcatggataaaattcattacggtgttttatcattcacccatgaaggactaccttatagtgtagctttaaatcacatcattattgataaccgtattttttttcactgtgctaaaagcggctataaactaaacagcattgaacagcgtgccacttatcttatagttgaagatctaggtattaatttaaaagcaggaactcataaccataattccgtcgctgtctttggaacagttcatgaagtaactgagtttgagacaaaaaaagctgcactattagaaatagtcagccatttagcgccagaacacccatacaatgataagatggtcgatacaactaatatcatcgaattagaaattgattatattaacggaaaaacacatattcgttaattatcaaattcacaataaacaaaggtaatactaaaatacttcaaatcaaacagttcctagctgtaatgccctttaagttgttttaacaacagagcttattatatctaggagctttttaaattcacaactactatttcactgtgttttgcagttctcattgcatatccccagccacccattcctgaggtcacgatcccatgaaaattattatttacttcaattccatagttcaaatcattaaccctaataaaactaaacaaaaaatttaaaggaaatatttgtccagcatgagtatgacctgataattgtaaatcaattcccaattgttcatttaattcataatcatgtggctgatgatccaataaaataagcggtttagaagtatctaaaggttccgtcaaatcttttaaagcttctcgcttttttacaacatagtctttacgcccaattaaataaatatcatccaatttagtaacatcgtccaacaataccttaatccctatttcttttaatttcttaacaatattaaattccctaagtggtgagccaccttggaaaccaatttcatgatttccttcaatataataaacagggtatttactagccaatattttaaatacctgtaatgaataatcaaattcatcttgggtggtaccttcatcatagatatcaccaagtagaataatcccacttggagcaatagcttcagcatgttcactaagctttgttaaatccgccttagtgacaactgttcctaaatggatatcagaaactaccattaggcttttatctacaaaagatttattgattattacatcatacgtagtaataacagtatttttagcattataaattccataaaaacttaaaataacactggcagccaaagcaaccattccccgttgataaataaatttaaaataacgattaaatctagttttatataaaattaaattaataatatcaaagattacaaaacaaatacatgcattagccaaaaaaccaaagaaaatcaaattatataaacacaagccgattaaaattccaataataactgttgtaataatctttcgatattttgctttagcaaaaaccaaatgtgtatgataagcaagatatactgtcataactgctaccaaagtcatctccattaaaacaaaccagctcataataaaatcatctccttagtaaattatatcacaaaataatcttaaattatctcactattgtcaataaaaaaactaaactaagatcatttgaaatcacttcttttttcgcacacttaagcttcaaaaatagtaatacattacaaaatctgtttagttttttatgttcttatttactaatcaaatcaattactacaatctcgcaatttttactagttctcatggcaaacccccaagtccccatccccgaagaaacgatcgcattaaaattatcatcatgacgataaccataattcatctcattaattcctaaaagattccaaagcggtaacatcggaaatacttgtccagcatgagtatgaccagagatcatcaaatcaattcctagctttttattttcctctaatgagcgaggctgatgatctaataagatcactggtttattctgattcatcccgttaataatctgttctacaggttttcgctttttaatcttataatcttgacgtcctacaatatttatatcctcaaattcaacatattcatcatttaaagtattgactcctgccaattgcaatcgttctaatatgttatgttcttttaatggggaactactataaccaacttcatgatttccaattacataatagactggataggatttagctaactgggtgaatattttcatcgaatcatcaatttcatcgctactggtattttcatcataaacatccccaactaaaaaaatcatatctggtttaattttctcagcttgcgtaacaagctgttttagatctactgttttaacagctgttcccaagtgaatatcggaaagtgccatgatctttttatccttaaattccttattaatacttacttggtaatttgtgattacaatattatttgcattatatatcccataaacactcaagcttaaactacaaataagtactccaataagataaactttttgatatggtcttttcaattttgtcttaaatataagcaggtaaattaaatccgcaattatcaaacaaatacacaaattgattaaaaatcctaaaattatcatttcaatacttacacttacagcaactaaaacaataattactgctgcaacaactctatgcttatttaaatattttttaaaatgatatgcaataaatatattgatcaagatagcaattactaccatcattacggttaaaatcaaaaactatccctcctttaagaataaattataccacagattatatttatggtataataactccgaggtgaaattatgcataaattagcgtgtccaaaatgtcatgaatcaatcgttcaagaaggaaattcatataaatgtgccaataatcattgctatgatctagctaaaactaaatatttaaatttgttattaaatcctgataaagctacaaataaccctggtgatagtaaagaaagtttagttgcccgcaaagcatatctaactaaaggatattatgatgtcattttaaattcagttattgactgtataaaaaaatatcgtgatgataccccactagatatacttgatctcggttgcggtgaaggatattatactcgaggattaaaagaaatctttagccaagacactatttatggattagatatatctaaagaagctatcaatatggccactaaatatactaaagatgtttattggcttgtcggtaatagtaagaacttacctatcgttgatcactcattagactttatcacagctctatttacagtcgtaaatcaagatgagctgaaacgtactttaaaaaagggtggttatattatccatgtaactgccaacccaaatcatctaattgaaataaaagaattaatatatgatgaaatcaaagttaaaagtgacaaatatattcgtttagattttgaaacaattgaaagttatgatctagttcatcaagtaaaaattgataatcgtgaagatgctttaaatttactaaagatgaccccccattattaccatataaaaaaagaacgccggggcgttcttgatgaattagaacgattagatattacaattgatattaaaataacaatatatcaaacaagcatcgattaaccgatgcttatttttattatcagtatgatttgaagtcctagaagtaaaggtattccatacttaaaaatatttttcctagtcttatgattaaatccatacatcgctaatatcgctcctagtgaaccaccaaacaaagcgcctattaatagtatcttctcagaaactcgccaatgatgatgaattgctttatacttatcaattccatataataatatcatcatcaagttaattataattatatagctgattaataatttcatcggtcttctgttatctccaaatagatatcacgattcccctaacaacatatttcaagagaacctattaaatttttatagtgtttctttgcattatattaaatcattatttcatcaaaatatttcgttatttaatactatttttatcgataaaaaaaacgaaccatcttaacaacattaaaacgacttttttcaaaaagaatccgcgcaggaatccttttttcatcaccacaatctaaaaagataatatctagaccctttttagtttcttcgtaaccgacaatcgttacccagtgccataaatcatctcgaatcttacgacgtcgatgtgttaagatcaataatcctaaaggattaccatgctcaatactctctttaacaatttcactagcatcataaagtcttggacgtctaaaaatacgatactcacaattatttaacaatttactcaatcgtcttgcatataaaaagacatacggaaatccacgcttaccaggttccatcagcttgaacatttcattcatgtagtctaaatacgttgatttatcaaattcacgttctcttttcgtataatagataaaaatatcagtagcactaacacttgcacaaccagctttacgagcccaagagtcagcaaaccaatcttgattaccaccctgaccaatcaattctttctctttataaatttttggataatctaaaatcatcatgccaccttctttccatatctccattatacgttattatgtccaagttcgtcactaattagataagaaaaagaactaaaattaagatgactttaattctctcgtttagtgccactgctatcatatttaagatactcctcaatatcattacaacctataaccggactgtcgccttaagtcttacgagccaacacccccaatatagcagcataattaataagatattcatcatcataatgatgtgataaaccgtaaaaaacggtaagagaactacgattatctctaattctttaatcaataaacaatctttttctagcattcttaataaaaatggtttgcaactaaaaaagaagatataaaattttatttaatcatgttatctcctcaagctgaattatattcagcttatgattctaaatgtttaaaaattgagctaacttactgtcttagcagtgagccttatattcataaaattcattatttaccaaaaaaattagttcttgatgaaaaaattgaagctgaaaatttttctatttatcgctttttgcatcaaaataattgtaagatctgttttgtaaaaataaaaaagggacaaaataaattttgtccacggggtgattaatcactacagatgattatcacctttttttgttttataattacttaatttatttgctaatattataacatattaatttgtttaatcaatagtcgaatattaagataagccaaatggaaaggtatccgtttggtttttgttttactatattttgcaaagtgcagttttactatatttagcaaagtgcgaaatgtttcgactaaaaatataaatggggcggtcgatgggaatcgaacccacgaatgccagagccacaatctggtgtgttaaccacttcaccacgaccgccgtatttactttgttaagaggttattaactctcaacgcaagaatgattatatataaaaatttgataaatgtaaagagaaaatgtaaaaaaaaataaaaaaactcaaagtttaaattctttgagtttttattctaataattctgagatatctgtttcaaagttattggaattttcacgactgaaatatgttgtataactctcgcttttttcatcattatcaataattgtcataacaaattcacactcatagcacaattccatgattgtttgcatcccttgataagttatactataagtctgataattatcattttcagtattaatttctaatttagcacgacttggataaatatcccagtcgattagatttccatcaactccccaatctattagaataaaagaaataggatcaataattgaatcgtcaaatttgtcacttgccttaatggtaatatataatttactaaacataatcacccctccattcaatagtatactaaattaattatcaataaatgtgtgaactatgtggaatatttaagataatatcatatctttcaaacatccaaaaaattctcttaaataatagtgtggagcagtatctaaattttctctagctgcatatgtatgagcttctaaaccgtgtttatttgctaatagtttacttcggtagcaatgaaaaccattagttattataactacttcatagtcttcagtaggcgatgtttcaataatttttttactatagataatattttcatttgtattagtacttttattttcttcgataatcaatgattcatctattcctttgttgattaaatagtctttcatagcttttgcttctgtgatgttctcgccgtggccttgtcctccgcttacaataattgggacatcaggaaatttttgatgatattcaacagctgcatctaatcgataacgtaatagtggtgcaggtttgtcgccgtataaacgagcaccaagaacaatgaggaaatcactgcgtttgttatacttattattaacctcatgtataattaaaccctcgataattataaatacaattacactaataataataattcctttaattgaataattaagaattttaggtaatgaggatagaatactttttctaaaatgtaactcatatacagcataacacattaataatgctgtaaaaatcggataaagtatataggcattgataaaccgagaattagtgacaactataatgaagtagaataatgatagcaaggcaagaaatagtagtatatagtcaaataatttacaattcttttccattataaaataaactccttttttatatcataacatacaagaagaaatatttttcttaaaaatatttaaatatggtaaaaaaaatggtgaaatagtataatgaaagtatgttgtaggatattaggaggactttaaatgaaaacaaaaaagtttgacaatttagggattgaaccatcattattggggtttggctgtatgcgttttccattagatgaggatgggaaaattaatgaaaaagaagcagaaaaaatgattgataaggcaattgaatcaggggttacatacattgatactgcttttccttatcataatggcgatagcgaaccgtttgttggtaaagtgttaaaaaagtataaacgtgaagatttctttttagcgacaaaattaccaatttggaatgtttcgagtaaagaagaggcaaaaaaagtttttgaagatcaattaaaaagattagatgttgaatatgttgatttttatttattacatgctttagatgctgataaatggagaaaagtattagaatatgacttgattggaatgtgtgaagaatttagagaagaagggaaaatccgtaatattggatttagtttccatgatgaatatccggtttttaaagaaattcttgaatatcatgattgggatttttgtcaattacaattaaattatatggatatggatattcaagcagggatgaagggctatttattggcagaaaaatataatataccaattatagttatggaaccgatcaaaggtggttcgttagcaaatttaccagaagatatcgaaaataaatttaaagcatataatcctgatttaagtatttcatcatgggcacttcgctatgttgccagtttgcccaatgtgaaagtagtgcttagcgggatgtcaacttatgaacaggtactagataatttagctacttttaaaaattttgagtatttgaaagctgaagaagttgctttgattcaagatgttcgtgatacattaaaagcaagaactcaaaatggttgtacaggatgtgcatattgcatgccgtgtccatttggagtggatattccaaataattttaaatattggaataatgcttttgtatatgatagtcatgatcaatttaaagcaaagttagaaaaaatggtttcagaagctaaagctgaaaattgtaaacaatgtggagcatgtgaaaagatgtgtccacaacaactgccgatacgagaagatttaaaacgggtatgtgaatatatgaaaaaataattatggtattaagtgaacctgattatttagactaaaagtaaatataaatactacttagatgttaattattttaatttgtaggttgaacaataaaaaaggagattttaacttaattagagtaaaatctcttttttattgtttagtgggtgtattcaattgtttcttttgaaagtaaccagttgaaaaaataattattactccaattattgtaattaaacatgcaaatataaacatcatatttaaaccatattgatcttgtaaaataccgccaaaaagatttcctatagtagatcctaccccagaagtcataatccctatcattgtttgacccatcatttgatcatgacttttgaggttatatgttacatagtaagttatcactgctgttagtaatccatacgataaactttgcatcatcattccaatgaataaaacagggagactaggtgctagacaaatagtaaaatttcgaataatatagaaaaaagctgcaaccataattaaagtgatactgtcatatcttctaattaaccttggagtaattgtcataacaggcatttcgctagctgccatgaagaagattgcaacaccgtacaatgaagtattaccgccaagatttttaacgacattgattaaataagttgatagcgaagttgcagcagcaaacataaaggagaagcctaagagaatgaaaaagaagactttataatttttaataattgtaaaaatattcccctcttttttatgggtcgcctgtttaacattggtatttggcaaagaatataaaattactaaatctaaaattgcagaaatgacgaagacatatgctaaaatagtcgggttaaaaaattcaatgaactgacccaagagcacagcactaacagcataagatatagaacccattcctcttgctaagccaaaatttatttcttttccgtcttgaatatagttcattgcaatcattgataaaaaaggaactgttgaaacaattaatgacatcattgaaacatataaaagcatgattagaataactgataaatcaactaaagctaaagttaaaaaagctccagcaataatcaaataaataatagataatagctgcttaattgttaggccttttatttttgaaattaaggatgtgacaaacggagataaaaaaatcgttaaaatacacccgcttccagaaacaatgccgatttcagtgttgctcattcctttatattgaagaaatacggcaacatatccgtaaatgcaacaagttgccatccaatataaaatatgcaataaattatatttcatttgtagttttttcatttttcttgtcctcatactctccatgaaaaacaaaatagctctcgagatgatactcaaagctattcgttatttagttgtaaatccatcatattttaagattaatatagcaatttttatttcttcgagcaagaaaaatagaggtttttcaaagattgaaaaaataaataaagatattgattttttaagaaccaatatctttattataaaattagcaatacttatattttaatagtgtgaattatgattgatcaatggctttaacaacacgacagggattaccaaaagctaatacatttggtggtatatctttggtaacgacactaccagcgccaattactgaaccatgccctatttttacccctggtaaaacaacgacattacctccaagccatgtgttatcaccaatttcaattggcattgctttttctaaaccttggtttcgacgtttataatcaagcgggtgaatagctgtatacaggccaacagaaggtccgatatatacgttactaccaatattgatcttggctccatccataaaataagcattggaattaataaatacattatgaccaaaggtgattaaattaccacaatcacaaaagaaaggtgagatgatttcaagattgctattctcattttggaatagttcatttaaaattttttgtcgaatatcctggtctagtgggtcggtatgattatatttaaaacaaaggtgatgggtattcagacgatctgttaaaactttttgatcgttattagcatcataccacatccctaataaagctttttctctttcggtaatgttagaaacattaaaaaggtctaataatgtttttaaaacgccataatgattatttgaagggataatcttataggcaatatttttaatactttgattggcattttccattacaaaactatattttgctttttttagcatttctaggtcatttggactatccccaaatacagcacattcctctaatgataggttatagcgcttacataatagctcaagtgcagtacctttattatatcgtggatcaattaagtcaatactttgatgaccactggaaactggtttaatgatatttccgatatcatcagttagcctatttaaaatatttttagaatcttcagctggaacaaataaagcaaattttacaatcgtgtcattaatttcatctaacgattcaatcatttcaagtcggtgatagtatttagaatatacattataaaattcatttgacgcattcaataaataagctgatttaattccgcataaacatatttgaatacgagaatcctcttgtaattttttagttattgtataaatatcttgtttattgatttcacagtgaaaaatttcttttttattttcaatgatatatgcaccattttcactaatgtaagtaatttcatcttgataatcatcaaaaaaagattttaattgataatattgattgccactggcaactacaaaataaatatcattttctttaaaataattataaatttttctaaaaattgtgcggttataatgcatttggtcatctaaaaaagtaccatccatatcaactgcaactagtttaatcataatttcacactccttgaaaatagtctaacataaatcagtaaatgatgaattctatttttaatacgtgaaaaaattaatgtgagttcaaataaaatgtttttagatgcaataacactagaacgataaatttataatttgatcacactgttggtattcgcttggtttatgggaaatcattaaaattgtgtgtgtcttctttaatttaattaatgtttgaaaaatttcatatgaagtcttttcatcaagagcactagttatttcatcaaataataaaattttagaattttttagaagtgctcgagcaattgctagcctttgttgttgtcctccagaaaaatttaaagcaccgtcacttaaaatagtatcgtattgttttggtagtgacataatatattcgtcgatttctgcctgttgacaagcttttttgatattattgatatcaggatcaataagtgcaaggttttcataaattgacatattgaacaaatacggatgttgggcaacacaagttaaaatctgtgaatattttatcctagaatacttgtctattggatgtgtaccaatcaatatcttaccactagttggtttttcaaagcgcaaaagtaaattgaataaagtactttttccacaaccactgggaccgattattgcaattaatgaatttgactttaggcttaaattgaagttttgaaagactgttttttcacgataagaaaaagtaacatttttaaatgtaatacaaaattcatttggtttgatcatatcatcattaagaaaatattcattacacgatgaattaataaaattatcataacgatcaattgatacattttttattctgagttcacctaaggtagaaataaagtcacttaaagagctgaataaagttccaaaataagactggataatgagtactgtgtcaatttcaaacttgccatttagacaattatagcaggcatagaacattagaataatttctgtacacattgtgatactaggactaattatgttactgattattttattgttaatttgtttatcgtgaatgtttagataagctttgttcaacaattgatatttggcatgtaattgatcaagaatactgaaaattttgatatctcgtaaaccgttaagcagttgactgtaaaattgcatttcatcatcagctttcaattttccttctttggttagaatttcaaatttatcattatatatgtttaaaatatagataacgatactattgatgatacatcctaagatcattaagctgatactaatttgactaagaataataattgaaataataaaagatagaaatagcaagatagcttgagatagccaagtaccaaactctgcgagtaatttaatatcaccattaacgatattaagaatttctcctttgctgtgattagtaaagtatttcatattaataatatctaattttttaatcatatcattttgtaactttaggtagacatcattatatagttttttttcaatattatagctgataattttaaataactttgatgctattttaagaacaaaatacaagatcatggtaattatgaccattttaccattttgtttagttaaataattaatcgttaagctaaacaataaacttgtaaacatataaggaccatttgctaataaagaagctaagaccagtataaaggttatttttttattagctttagtaacttgaaaatattttttaataattcttagatttttcattttagaaatttatttatagcattttttaaaagagtttggatctcttcctcttttaaagccatgttaccaccatatatttgagttgcaattccatgggtataaaaacgaatatcacgataaagtatctcactttctttaattgtaataccaaattgttgtgctgaatattcaatcgtttcacgattccaagcggaatggacgacttcttcaatggaacgagttttgataaattcattgacaaacaatgctccaaatagattcttttctttgatggcaaaatcaatataagcaaaagacatcgtgtaaagataattatttttatcaagatgtgctaagatgaaatcgttgtaatatgcatcaatttttttctttaattcaaattttaattcattcatatcattaaaaaccttaaagatgggcattgttgaacagtttagttgtttagcgagatagcgtgcatttagattttcaatcccctcggatttagtaatttcaaatgacttttcaataattaactcttttgttattcttgtttttggtggcataattgactcctttcatataaaataacatatgttatataacgattgttattttatataagaacatgtactttgtcaatatacaagggataaatatttaataaacatattttacatatactgctctttttttattttatctaatcatactataatttatttgagttactttaggtcaagtgtttttattaattattttttaattgttttaaaataatacaagcagccttattaataaaattatatattatataatagttgtatatatttaaaaaaaggcatgataagtggtgaatatggttacaatagatacgctaataatatagatagaatgttagattgtaaattacttgagaaaaaggtgatatttttataaacaaatggtttgtgatataatatgtgcaagaattggagagtgataatgatgaaaatagtagcatttactggtgcagggataagtaaacaaagtaatattccaacctttatggaaagaccagatgttagagaaaagttatttagaaattatgctaataaccatcatgaagaatataatgaagtaatcaaacaattaaaagctaacatgaatggggctgagcctaacgatgcccatattgcattagctgaatatgatattcctattattacaatgaatatcgatggtctacataaacaggctgggagcgatgccttagaattgcatggcggattgccggaagaagatgaattgagtatagcctggtcattatttaataaaccagtattatatggtgatccggcacctaattatcaaaaggcctatgagatggtaggggcattaaaaaagaatgatatatttattgttattggctgttcgtatcatacggcgatagcttgtgatttaagagaagtggcgaaatcaagaggggctaagattattgaaattcaagaagatgctgctcataatgttagaaaagtgttaaaaggactattaaaataattatattaattgacattttgattatttatcggtattataagttcatataataaatacgatgaattgaaagagtaaactaggcgtttaggcaaagagagtatcgggttggtgtgacgatatccaaataaatagttgaatacatcaaggagtagaatgttgaagtaagtaggcatctccggtgacacccgttaatgtgtaagagtatgaactatagttgtatagcgtacttgatgaggctgatagagtgatctattagtgaataaaggtggtaccacgaagatatctcgtcctttgattaggatgagttttttatttataggaggaaattaaaatgattattgtcttgaaaccacatactagtgatgaaagtattaaaaaaattgaagatgtgattagagctaggggggctgaaccacatgtttctaaaggagaaatccaaacaattattggaatggttggagatacaactcaaattgatcctaaagcaatcgaagtagaaccatgtgttgagaaggtcatgaaagtatctgagccatataaacttgctaaccgggcttttcatcctgatgatacgatcgttgatgttgctggtgttaaagtataaaacaaaaaaaggtgataatcatctgtagtgattaatcaccccgtggacaaaatttattttgtcccttttttataatcttttatagttatttaaatctagtaatgaagcagcatcttgatcacaaataaccgtaaagttaggatgcagttttaaaatggtagctggtaattcgtcagtgattggtgaatcaagcatttgctttaaaatttctgctttttctttacctgtgacaatcattactaggtgttttactcgcatcaaactctttggacccattgttaaagttaccggttgttggggtttatcagcataagcgggattaaccgcatttttaattttgcgttctaatgcataagtatagctgtccattggtgtacagcgaggacagttactacaaaagtgaccatcaaatcctaacccaatcagcattgcatcgatttctccggcattacgaatctgttcatcaaaggtttcccaattgtccatagtagtgatatgaactcgatcggcaggaatattagctggttcaaaaaacactttttgcatttctttccagttttcaccatcttctttagctgtttttccaatatatggggcttcatcgaataaataatattgcacatcagcgaattttgcttgatctttaacatatggaatcatcattttatataataattcgggtgaacgaccagcggttagtgaaatatttacacgcttatcttgcatcattgttccgagtaaaatttgcatcgcactttcactcattttttcttttgaatcttcaataattaatttcataatctttctccttgattttcatattttatgaaacatcttggataaagaagtaaagcttacacaaaggctattctaaggcaataaagatattaggtcaaggtaattttggtaaaataattaataatatttatattttttaaaataactttttttagctattttttcattttatcataaattcaactaaaataattagtgatttccaaatattggaaattatttcgcaattatgcaaaataattgtttatagactggttgagtttatataatcatggggaggttaaaagaagggaggaattaaaatatgaattttattgaaaaattcaatgagattgccaataagactttagttccaattgctaataaacttgggaaccagcgtcatttggcagcaattcgtgatggtatggtagtggcgattccattatcgattttaggtggtttttgtttaattatttcaactccaccatttacgccaaagagtttaccggattggggagtaattagtgatctattaattggctggtataattgggctcaggccaatgcaacagctttgcgactgccgtacaatatgacaatggcattaatggggctatttgttgctatcgcgatcgcatatcatttggctaaaagatatgaaatgtcaggattaaatgcagcgattgtttcaaccacagtatttttattgatttgtgcaccaacaacaactgcggtattgactagtgcaattagtgagggggccaacactaatgatctattagcacaggcagctagttttattcctacgacctacctagatgctaaaggtatttttactgctattattgtttctatcggctgtgttgaaataatgagggtgatgttgaagaaaaatattcgttttaagatgcctgagggagttcctccagcaatcgcttcatcatttgattcaattttaccactatttgtttgtatgggagtcttctatggcttatcattgattattcaaaatattagtggtgaattattacctagtttgatcatgacgattttagcaccagcaatttcaggattagattcattacttggaatttgtttaattacaattattgctcaaactttctggttctttggtttacatggtgcaagtattacgcagccaatcagactgccgtttatgcaaatgtatttaatggcaaatatcactgctttttcagctggtgagccaattgtcaatttctttactcaaccattttggtcttatgtaattacacttggtggcggaggtgcaacattaggtttatgtattctcttgttacgctcaaaatcagtagagttaaagacattaggtaaattatcaatcggaccagcaatttttaatatcaatgagccaatcatcttcgggttaccaatggtcttgaatccgttaatgatgataccatttatttttgtaccggtaattaatacaattattgcttatacttgtatggctttaaatattgttggaaagggcgtagttgagactccatggacaactccggcaccgattggcgcagccttgggctgtatggatatcaaagcgggaatcatggttattatcttaattattttggatatgctgctttattatccattctttaaattaatggaaaaacagaaattagctgaagaaaatagctaatttattaaaagttgatacaatcaaggataaagataaacttacacaccaaaaagagattttaaatctctttttattttaaaaatttattggagaagaaaaatgagtaaaaaaagagataataaaagaaaagtagagataaaaggctacgatattgctaagttgcgatttcagcgttttttagcaatggtcattgactggtatattagtaatatgattgtcgctattcctgtaactttttttcttaggggtaaggactatattcaaccatattcttttcaactagaaacatatggctataaaataggaatgatctatggtctgtttgttgtagttgttgggatttgttattattttgctgttccgacatatatatggaaaggtcaaactttaggaaagaaaatttgtaaactacaagttgttaaaactgatggacaaaaagtggatacaaaaacaatgtttttaagagaaatcattggtgcagtagtaatagaaggtgggattgtcgtttcagccacgtatatccgtaaattaattggcttattgattacagccgagattattccgattcttaaatatggagcgtatgcaataaccctcgcttcaattatttatgcgtattttaatcctttatcacaatcttttcatgataaactagcaagaacagtagtaattagaaaataaaattagacattttaactgttcatgatatactattgaattattaatagattttatgaagggtggaactggtatgtataatttaacgattatcttgttatcaacgatcaatagcgaattaattaattctaataattatcgaattgctaaatatattttagagaacatgcgggctctggaggatatctccataaccgaattagcgaaagagtgctatgtgtctaattctagtatttctaggttttgccgtgatattggcttacgagattataatgagttaaaaagtcaaattgcaaagtaccagccagctcaccagtatgccaaaaataaattctattatcaaagttatcaaaaagaggttcctggtcaatcctttgttgaaggggttatagaaaatttacaattattaaagagaacaattaacgaaaaagatatttataaattggtaactgatattgcgaattattcaaatgttgcagcctttggatatatgcaatcacaaagtgttgcccaaaatttacaatatgctcttcaaacatgccataaatttattcatacatcaatgaaatatagtgatcaaattgaatatatcaataatgctgatagtagtaatttgattattattttatcagaatccggtacttattttaaacgagcttttgaaagaaagacattatttagaaatactaatgacaaacctaaaatatatttaattacttgtaattcggatattgaaattccctatgtagattactatattcgctatgaaagtattaatgactatgccagtcatccatattcattagcagccattacgggaatgatctgtacatgttatgcggagcggtatctagaggctcctgaaccaatttaaaaagtaaagcgactcctaaaagagtcgctttacttcgtacaaataaataaaccagagtccttggtgatcttaatcccctgggattctttgattaaatcttcgatatatattttaaattcttttagtcgattaccaaggtattcgttttgattaccatgacaactaagaatataatcgataagtggttgggcttcagttattaacaaataatcttcatatttttttaattccacataattaaaatagctttttaaaatatctttaccattttcaagaccgaaacgttcaggaagaggatcatcagataaagagatacgtgagtcaaagttttgagcaagttcgctaatttcctgcatatgatatttactgtaggtcgtgcaataaaaagtaccattattctttaagacacgagttatttcagttaaaccttgttttaaatcctttaaataaaaaagcatgtgattagcaacaattgtatcaaagtagttatttttaaaaggaatactttggcagtctgcaacaatataattataatcatttccaagtttttgacgaatttcatctatcattccctcagaattatctgataagaagatttctcgattacgaagattatatgtattgttctcccataatttaccatttccacagccgagctctaatagacgatacacggtggaaaaatcaatttgttcaaaaatccagggaaaccagccttgctggtttattgaaaatttgtcatgcagtttgattcgtgtatcaagatttttagcattcatatattgcgtgacaagattatcatcaattgttgataagcggatcagttcaataattttgtcccaggcgatattttttttattgattagacgctctgttgcttttaaagaatcttttagattggttaaatgtttgattttctgatcaattagattggtttgcagtttaatcgactctttaaagttatcctggttattatcttgaataagaggataaatttcttcaagtgagaatcctaattcttttagtgagaggatcttttgaagggtaattaaatcacgattgcaatagcggcgatatccgttatcaagaatttttgttggttttaaaagaccgattttatcataatatctgattgttcttaaggtgacacctgccattttcgcaaattcaccagttgaatatagtttttccatagttatattataaggtgaagtgttgtttttttaaagaaaaataaatttttaatctaatttagaaacgaatatattattgtgttagaaatttgttagaaattgttaaagattatgttaaaattaaatttggtgatagtaatgagtaaaaggcatagagctgtatcaataattatatttagtatttttttatttttatcgttaatgatttgtacttcggtattgtggtgtaatcgtacttttggaaaagtagatatggatcagttgttgtttactgtattagctccgacaacaagtactgatcatggtattattattagctggattttagaatcacttgttttttctttggtaataatggtaattgttttaatttcttactatttgataagaaaatattgggcaaatagatttgtgaaaccaagatttttatatgtgattaatcgtcatctatgggttttaggagttgttttattggcaggtgcgttatctatggcagaaagtaattttggggtatttgactatttgcgcaaaagtaatcaaaaaacggaaatatatgagccgaaaaagattgctgtaaagaaagaggtttcggacggagatccagaacttatttatgctgatccaacgagtgttgcagtttctggtgagaatcctaataatttaatatatatatatttagagtcttatgaaaatacgttcatggatgttgttaatggcggtatcaaagaaattaattgtttacctgagctgactcaattagccaatgagaatattagtttttcaaatactgacaaagctggaggggctttggggtttactggaactacttggacgatagcttcaatggtagggcagtcatcaggcttgccattaaaatcagaagtagctaatgatatgagtaattatgctaaatttatgccgggagcaaaaatgattggtgatattcttgcggaaaatggttatattcaggaattttgtattggaggtaatgcgactttcgcggggactgataagctgttcgaacaacatggaaactataagatcgtagattataaagcccttaagaatgatggacgagtgcaacgaggtgaagtgtgcgagtggggaataaatgatcagggcttatttagaattgctaaggaggagataactaacttagtcaatagtggtcaaaaatttaattttacaatggcaacaatagattgccatacaaccgatggaattaaatgttcactttgtccgaatacctattcaaatagatatgagaatatttatgcttgtcaatcaaaacaagtaaataattttatctcatggtgtaaggaacagtcctggtttgcaaatacaacaattgttttagttggtgatcataatactatggcggttaaatatactaaagatattcctgctgattatgttagaacgacatataactgttttattaattctaaagtatcgagtaataatataaaaaacagacagttcagtcatttagatatgtttccaactacgttagcagctatgggatttaaagtagatggaaataagttagctttaggtacaaatctttttagtagtttacctacagcgattgaaaagtatggtcaggcttatattgaggctgaagttcaaaagagttcaacttttttagatgagaatatttataagtttaattaagtattgcgttgatttttattatatgtttcagaaagtctagaaaagagtctaataaaattatttaaagaatattttaggaagaaaagtatataccagaaatattaattataacatttttcttattaattttaatagtcaatagctttcttattgtataaccataaattatttcgtaagcattataggagagaatgctcgaaaaactatctgtgacatgagtgcaagtatagttttataaagataatattgtctttatttaaaattggattggagtatttaactgttttttgtatgttaaatattttaattggttatattagtattcaaaatattaatattagttataaggaagaagtaggagagttaagtttttggctcttctattttttgatataatattttattgatttaaaaattatttattaaaatttctatatatttaataaaactatattttgataatagaaaagtaggttgtgaaaaaagctaaattatgtacggattggtttaaaatatagattcactttaacaattctaaataaaaatcaggaaaggaaaagtatattgaattttttgttaatgatttgatgataacagattagattctaatatacagagaaaagttttatgaaaaaatttttaaagttatttgtggtagtaatgcttacatgcacgacgctagtttttacattaggcatttttacttcacccctttcattaagtgcaatggagttaccagcaataaattatcaagctcatgttgaagataaaggttggttagatacagtccatgataatgaaattgcaggaactgtaaatcaaagtaagcgactagaggcgttaattttaaatcttaaagaaaatgataaaagtatggtaagatatcgtgctcatatagctgatgttgggtggcaagcatgggttacatcaggagctcaagcaggcactacagataaagcaatagctatacaagcgtttcaagcagagcttacaaatgagtacaaagatatgtatgatatttattatcgggtacacgtgccatataggggttggctaggctgggcaaagaatggagagattgcaggatcgataggacttgcacttcgaacagaagcgattcaaattaaattagttattaaaggaagtcaaatttcaacagagggattatcatcactaacaaaaccaacattaacatatagctctcatgtgcaagatatgggatggatgagttatgcagatgaaggtaagatggcaggaactactaatcaaaaaaagagaatggaagctgttaaaattaaattaagtgattttgatggtaatagtggattaacatatcgaactcatgtttctgatgtgggttggcagaattgggtctctagcaatgaaagagcgggaactgaaggtcaaaataaacctattgaggcaattgaaattagtttatcaagaacaatgtctgatttttttgatatctattatagaatgcatgtttccaatatgggttggttaggttgggcaaagaatggagaaacagcaggtacgatagggggaaggattcaatcagaagcaattgaaattaaacttgttcctagaaactccacatttgatagaggtggtgtggcttttgtagatgctacaattacgatacgtgaccgtatcgttgatgcagcgcattcgagattaggatgcccatatgtttggggaggaaatggtcccaacacatttgattgttctgggcttgttaagtggtgctatgctcaagtaggaattagtattcctcgaacaacaggtgaattaaagagttatggtactcaaataagtgtatcacaagctttaccaggagatattttatggaagtcaggtcatgttggtatttacattggtaatggtcaatatatccatgcacctcaaactggtgatgtagttaagatttcttcagtatcgagtggtaactttacttttgctagaagatctaatgagttataaagaatatattaaagactcgtacttttgaagtgaagtcgagtctttttctaaattatttagttaaatgtttaatatcaaaattatctaccttttatactcatcactatttttaattttagttttgaaccttggaaaatagatatattgttttctaattcttaattacatgttggatattttactattactatatgcatcctttaatcccacccagtattatttaataaaaatcacaagaatattttttatcgagtatctaaattagtttaatatttttattatcaataaaatgagtgatggtaacgatttggtttaccagtttaaaccagtaaacattcatgaggttattgttgagtcatatcaatatcttaaagtattttgactagagtttgttataacctactcgttattaaattttaaatatttttcatgattatttaaaattataaatatttgaggtaaaaaaacagtaatgatcattttttattagtttcattactgtttttattctataggaatttggattcgtctgataataacagtatatcattccaactaaaagggtacctgatttatggtacccaaataaaaaataaaaaataaaaagaccaaatagtaaatggtacactcttacacactatcatcctcatcgtatattataatagatatatacaatacatgtttttacccggatcatagaattcttaagacaaataaaatttatagagacttgttcagtctacttctctctaaactaggccccggctcctgccagtacccacttagaaagaaataaaaaaacaaatcagacaacaaaggcttaatctcagcagatcgtaacaacaaggctactctactgcttacaataccccgttgtacatctaagtcgtatacaaatgatttatccccacgcaaaatgacattgcaattcgccagcaagcacccaaggcctttccgccaagtgcaccgttgctagcctgctatggttcagcgacgccacaaggacgccttattcgtatccatctatattgtgtggagcaaagaaatcaccgcgttctagcatggattctgacttagaggcgttcagccataatccagcggatggtagcttcgcggcaatgcctgatcagacagccgcaaaaaccaattatccgaatgaactgttcctctcgtactaagttcaattactattgcggtaacattcatcagtagggtaaaactaacctgtctcacgacggtctaaacccagctcacgttccctattagtgggtgaacaatccaacgcttaccgaattctgcttcggtatgataggaagagccgacatcgaagaatcaaaaagcaatgtcgctatgaacgcttgactgccacaagccagttatccctgtggtaacttttctggcacctctagcctcaaattccgagggactaaaggatcgataggccacactttcatggtttgtattcacactgaaaatcaaaatcaagggggcttttacccttttgttctactggagatttctgttctccatgagccccccttaggacatctgcgttatcgtttaacagatgtgccgccccagccaaactccccacctgacaatgtcttcaacccggatcagccccgaatgggaccttgaatgctagaacgtggaaaatgaattccagctccgcttcattgaataagtaaagaaactataaaggtagtggtatttcactggcgccgaagctcccacttattctacaccctctatgtctcttcacaatgtcaaactagagtcaagctcaacagggtcttctttccccgctgattctgccaagcccgttcccttggctgtggtttcgctagatagtagatagggacagtgggaatctcgttaatccattcatgcgcgtcactaattagatgacgaggcatttggctaccttaagagagtcatagttactcccgccgtttacccgcgcttggttgaatttcttcactttgacattcagagcactgggcagaaatcacattgcgtcaacatcactttctgaccatcgcaatgctatgttttaattagacagtcagattccccttgtccgtaccagttctaagttgatcgttaattgtagcaagcgacggtctacaagagacctaccaaggccgtctacaacaaggcacgcaagtagtccgcctagcagagcaagccccaccaagcagtccacaagcacgcccgctgcgtctgaccaaggccctcactacccgacccttagagccaatccttatcccgaagttacggatctattttgccgacttcccttatctacattattctatcaactagaggctgttcaccttggagacctgctgcggttatcagtacgacctggcatgaaaactattccttcctgtggattttcacgggccgtcacaagcgcaccggagccagcaaaggtgctggcctcttccagccataagaccccatctccggataaaccaattccggggtgataagctgttaagaagaaaagataactcctcccagggctcgcgccgacgtctccacattcagttacgttaccgtgaagaatccatatccaggttccggaatcttaaccggattccctttcgatggtggcctgcataaaatcaggcctttgaaacggagcttccccatctcttaggatcgactaacccacgtccaactgctgttgacgtggaacctttccccacttcagtcttcaaagttctcatttgaatatttgctactaccaccaagatctgcactagaggccgttcgacccgaccttacggtctaggcttcgtcactgacctccacgcctgcctactcgtcagggcatcatatcaaccctgacggtagagtataggtaacacgcttgagcgccatccattttcagggctagttcattcggccggtgagttgttacacactccttagcggattccgacttccatggccaccgtccggctgtctagatgaactaacaccttttgtggtgtctgatgagcgtgtattccggcaccttaactctacgttcggttcatcccgcatcgccagttctgcttaccaaaaatggcccactaaaagctcttcattcaaatgtccacgttcaattaagtaacaaggacttcttacatatttaaagtttgagaataggtcaaggtcatttcgaccccggaacctctaatcattcgctttacctcataaaactgatacgagcttctgctatcctgagggaaacttcggcaggaaccagctactagatggttcgattagtctttcgcccctatacccaaattcgacgatcgatttgcacgtcagaaccgctacgagcctccaccagagtttcctctggcttcaccctattcaggcatagttcaccatctttcgggtcccaacagctatgctcttactcaaatccatccgaagacatcaggatcggtcgattgtgcacctcttgcgaggccccaacctacgttcactttcattacgcgtatgggttttacacccaaacactcgcatagacgttagactccttggtccgtgtttcaagacgggcggcatataaccattatgccagcatccttgacttacgtcgcagtcctcagtcccagctggcagtattcccacaggctataatacttaccgaggcaagctacattcctatggatttatcctgccaccaaaactgatgctggcccagtgaaatgcgagattcccctacccacaaggagcagagggcacaaaacaccatgtctgatcaaatgcccttccctttcaacaatttcacgtactttttcactctcttttcaaagttcttttcatctttccatcactgtacttgttcgctatcggtctctcgccaatatttagctttagatggaatttaccacccacttagagctgcattcccaaacaactcgactcttcgaaggcactttacaaagaaccgcactcctcgccacacgggattctcaccctctatgacgtcctgttccaaggaacatagacaaggaacggccccaaagttgccctctccaaattacaactcgggcaccgaaggtaccagatttcaaatttgagcttttgccgcttcactcgccgttactaaggcaatcccggttggtttcttttcctccgcttattgatatgcttaagttcagcgggtactcctacctgatttgaggtcaaactttaagaacattgttcgcctagacgctctcttcttatcgataacgttccaatacgctcagtataaaaaagattagccgcagttggtaaaacctaaaacgaccgtacttgcattatacctcaagcacgcagagaaacctctctttggaaaaaaaaaacatccaatgaaaaggccagcaatttcaagttaactccaaagagtatcactcactaccaaacagaatgtttgagaaggaaatgacgctcaaacaggcatgccccctggaataccaaggggcgcaatgtgcgttcaaagattcgatgattcacggaattctgcaattcacattacgtatcgcatttcgctgcgttcttcatcgatgcgagaaccaagagatccgttgttgaaagtttttaatattttaaaatttccagttacgaaaattcttgtttttgacaaaaatttaatgaatagataaaattgtttgtgtttgttaacctctgggccccgattgctcgaatgcccaaagaaaaagttgcaaagatatgaaaactccacagtgtgttgtattgaaacggttttaattgtcctataacaaaagcacagaaatctctcaccgtttggaatagcaagaaagaaacttacaagcctagcaagaccgcgcacttaagcgcaggcccggctggactctccatctcttgtcttcttgcccagtaaaagctctcatgctcttgccaaaacaaaaaaaaaaaaatccattttcaaaattattaaatttctttaatgatccttccgcaggttcacctacggaaaccttgttacgacttttagttcctctaaatgaccaagtttgtccaaattctccgctctgagatggagttgcccccttctctaagcagatcctgaggcctcactaagccattcaatcggtactagcgacgggcggtgtgtacaaagggcagggacgtaatcaacgcaagctgatgacttgcgcttactaggaattcctcgttgaagagcaataattacaatgctctatccccagcacgacggagtttcacaagattaccaagacctctcggccaaggttagactcgctggctccgtcagtgtagcgcgcgtgcggcccagaacgtctaagggcatcacagacctgttattgcctcaaacttccatcggcttgaaaccgatagtccctctaagaagtggataaccagcaaatgctagcaccactatttagtaggttaaggtctcgttcgttatcgcaattaagcagacaaatcactccaccaactaagaacggccatgcaccaccacccacaaaatcaagaaagagctctcaatctgtcaatccttattgtgtctggacctggtgagtttccccgtgttgagtcaaattaagccgcaggctccactcctggtggtgcccttccgtcaattcctttaagtttcagccttgcgaccatactccccccagaacccaaagactttgatttctcgtaaggtgccgagtgggtcattaaaaaaacaccacccgatccctagtcggcatagtttatggttaagactacgacggtatctgatcatcttcgatcccctaactttcgttcttgattaatgaaaacgtccttggcaaatgctttcgcagtagttagtcttcaataaatccaagaatttcacctctgacaattgaatactgatgcccccgaccgtccctattaatcattacgatggtcctagaaaccaacaaaatagaaccaaacgtcctattctattattccatgctaatatattcgagcaatacgcctgctttgaacactctaattttttcaaagtaaaagtcctggttcgccaagagccacaaggactcaaggttagccagaaggaaaggccccgttggaaatccagtacacgaaaaaatcggaccggccaaccgggcccaaagttcaactacgagctttttaactgcaacaactttaatatacgctattggagctggaattaccgcggctgctggcaccagacttgccctccaattgttcctcgttaaggtatttacattgtactcattccaattacaagacccgaatgggccctgtatcgttatttattgtcactacctccctgaattaggattgggtaatttgcgcgcctgctgccttccttggatgtggtagccgtttctcaggctccctctccggaatcgaacccttattccccgttacccgttgaaaccatggtaggccactatcctaccatcgaaagttgatagggcagaaatttgaatgaaccatcgccagcacaaggccatgcgattcgaaaagttattatgaatcatcaaagagtccgaagacattgattttttatctaataaatacatctcttccaaagggtcgagattttaagcatgtattagctctagaattaccacagttataccatgtagtaaaggaactatcaaataaacgataactgatttaatgagccattcgcagtttcactgtataaattgcttatacttagacatgcatggcttaatctttgagacaagcatatgactactggcaggatcaaccagataactatcttaaaagaagaagcaacaagcagtaaaaaagaaagaaaccgaaatctcttttttttttcccacccattccctcttgctagaagatacttattgagtttggaaacagctgaaattccagaaaaattgctttttcaggtctctctgctgccggaaatgctctctgttcaaaaagcttttacactcttgaccagcgcactccgtcaccataccatagcactctttgagtttcctctaatcaggttccaccaaacagataccccggtgtttcacggaatggtacgtttgatatcgctgatttgagaggaggttacacttgaagaatcacagtcttgcgaccggctattcaacaaggcattcccccaagtttgaattctttgaaatagattgctattagctagtaatccaccaaatccttcgctgctcaccaatggaatcgcaagatgcccacgatgagactgttcaggttaaacgcaaaagaaacacactctgggaatttcttcccaaattgtatctctcaatacgcatcaacccatgtcaattaaacacgctgtatagagactaggcagatctgacgatcacctagcgactctctccaccgtttgacgaggccatttacaaaaacataacgaacgacaagcctactcgaattcgtttccaaactcttttcgaacttgtcttcaactgctttcgcatgaagtacctcccaactacttttcctcacacttgtactccatgactaaaccccccctcccattacaaactaaaatcttacttttattttcttttgccctctctgtcgctctgccttaactacgtatttctcgccgagaaaaacttcaatttaagctattctccaaaaatcttagcgtatatttttttcttttttttttccaaagtgacaggtgccccgggtaacccagttcctcacttttttttactgcggaagcggaagcggaaaatacggaagcggaaaatacggaagcggaaaatacggaagcggaaaatacggaaacgcgcgggaacatacaaaatatacctttctcacacaagaaatatatgctacttgcaaaatatcataccaaaaaacttttcacaaccgaaaccaaaaccaacggatatcatacattacactaccaccattcaaactttactactatcctcccttcagtttccctttttctgcctttttcggtgacggaaatacgcttcagagaccctaaagggaaatccatgccataacaggaaagtaacatcccaatgcggactataccaccccaccacactcctaccaataatggtaactattctatgttttcttactcctatgtctattcatctttcatctaactacctaatactatgcaaaaatgtaaaattatcacacaaaacataaacaatcaaaatcagccatttccgcaccttttcctctgtccactttcaaccgtccctccaaatgtaaaatggcctatcggaatacatttcctacatcctaactactataaaacaacctttagacttacgtttgctactctcatggtctcaatactgccgccgaaattctgtcccacatactaaatctcttcccgtcattatcgcccgcatccggtgccgtaaatgcaaaacaaataccatctatgtcttccacaccatcattttactatgcctgccaccatccatttgtcttttgcaccatatcttcataacctgtcaccttgaaactacctctgcatgccacctaccgaccaactttcatgttctgtttcgacctacctcttgtaaatgacaaatcacctttttcatcgtatgcaccttattctccacatcacaatgcactattgcttttgctttttcacctctcatatcctattgctattagatgaaatataataaaaattgtcctccacccataacacctctcactcccacctactgaacatgtctggaccctgccctcatatcacctgcgtttccgttaaactatcggttgcggccatatctaccagaaagcaccgtttcccgtccgatcaactgtagttaagctggtaagagcctgaccgagtagtgtagtgggtgaccatacgcgaaactcaggtgctgcaatctttatttcttttttttttttttttctctctagtttcttggcttcctatgctaaatcccataactaacctaccattcgattcagaaaaattcgcactatccagctgcactcttcttctgaagagttaagcactccattatgctcattgggttgctactacttgatatgtacaaacaatattctcctccgatattcctacaaaaaaaaaaaaacactccggttttgttctcttccctccatttccctctcttctacggttaatcctttcctcttcgtctttttctacgccctcgtttagttgcttctttttccttcccgctttcctgcactaacattttgccgcagtacactatacgatcgtagtacatcttacaactccgcataccgcgtcgccaaaaatttacttcgccaaccattccatatccgttaagtatacatgtatatatattgcactggctattcatcttgcacttttcctctttcttcttcccagtagcctcatccttttacgctgcctctctggaacttgccatcatcattccctagaaactgccatttacttaaaaaaaaaaaaatgtccccactatcactgttcactgttcacttgtctcttacatctttcttggtaaaatcgtagttcgtagtattttttttcatatcaaaggcatgtcctgttaactataggaaatgagcttttctcaattctctaaacttataaaagcactcatgtttgccgctctgatggtgcggaaaaaactgctccatgaagcaaactgtccgggcaaatcctttcacgctcgggaagcttcgtgaaagcccttctcttttaacccatctttgcaacgaaaaaaaaaaaaaaagagttaaatgaataataatctacatttgctaaagcacatatcctgctcatatgaaaatattttgattttttcaacagctttctttcagctgactcaaatccatttcattaagtactgtcacatcagaaataacttctccaaaatccactaactctaacagaacaatacagtacctaataaagtagtcagcaagctcaaaaaaagatatataatcatatctcaactggaagatttcaacgataacttctttttgtacaaaggtaaaacctatatatcaatatcaacatttagaagatggtttaataaggatgttaaatcttcaggtgttaaaaaaaaatactgttcacggattaagacactcacacgcatcttatttattatctaatccactcatatccgaacttttaatagccgaaagacttggacatagtgttgaaatgctacgtagcagatatgcccatatatatgagaaaagcagaaaaaatcttgttgaatatattgataatttataaaatgtataccacctatactcacaaacaactttcattacgaacaaaaaaagcataactgacaacttcagaataagctctatactaagacttaaattgaataaaagttatgcttttcttgtgtttgattttatcgctatttattacgaagtttcatttgtggtgtatttacagttttgtaaacaattacataaaatcatactactaaataaatgctaataattggatcagatatccataaaggctttagtcctactacaacgtctttttggaacatttcgcttttgagataagcttctgcatgttctgtgctatcaaatccatgtaacacttgaacatctttttctcttattaataaatcttttgttaatgctccttcaatagtttttaaaaacggctcacgataatccgtataaacttttgcagctgctactctgttagtttccgcaatctgcatggtaatttctaaatatgctttgacagtcattttcatctctccttttttcctttgtacaaacatattatacaaaatcgcatatcattttaaaattcattaagaaattaataagttactattaaatttctaagtatcttgttattataaagtatagatattataatgaagttgtaaggagggaaatattatatgtatcaacacaaattagataaggatattcgttgtccattagagtacggattagagatatttggaggaaagtggaaatcgagaatcatttgtgttctagcaaaaaaagagatacttaggtatagccaattacgaaaagaaatgggcaatattactgatgctgttcttgcttctatgcttaaagaattaattaataacaatatcgttactagacaatcttatgatgaaatacccccacgagttgaatattcattaactgataaaggaaaatctgttgttcctattctacaaaatatttgcaaatggtctggagtttatcatcgtgaaaacagtgataacactatgattcaatgcagacaatgtgactacaataaataattaaagccgacttattggaagtcggttttttaaataggtattttataaaaataaaattaagagattataataaataattgctattaaacaaaacaataatgtttttgggattgttttacgtatcaaatctcctaaactgactttaaaataatctgctacaacaactaaacaaatatgagtaggtgataactgacttgctccatgacatatacacattaacaataccattaatggcatgccaccctgaatagttgcaaatgctattggtgttcctaaagctataattccacttgatccactaatgatccctccaatgaaaaataatataacaaaaaccaagtatggtggaattggcaaacttagtaataaatctggtaatacatttaaaactcctgtataagcgataaattctttaaatactaaaactaaaaaggtattcactatcattttcttttcaaatgcctttgtaatcaatggcagcaattcattgattttaaatctataaatcatacaacatagagcaatgactatcaatactgcagaaacaattgatagatgaaatagtaaaataagcaccaaaatcattaatagtgaccataaatgttgaaacaaatgaataaaatctttcattctattttggcttttaggtgtattcgtacttgatggtattttcactaatattgaaaaatagccaattaaagcaagagcgaaaacaggtataatcatcccaatcataaattctgataatggaacacctgaaatattcgccattaataaaacagctgcatatgtaggtaaggtgctttcaggtatgtgcctaaaccaactagcaacaaatgcctgatcttttggttttaagtacccatcggttgcatctttaacaatatccccacataaaatcattgcagcagcggatggtagtaaccctataaataatggagcacctccagcattgattcttctgttatggaaaagcccatttaaatcttgctgagctaatttgatttgttgtcttttttctaacattttttgcaggaaagtaataagatataatgaaattagaatttgtaatgaactccaatttgtaaatacatgagttatctgtataaaaatatcattaaaaggaattttataaagaataaccatcataattaatccaccaataattgattgatataatggacgacgaaacattaataacaatacaataatcaaaaaaacaattcccaaataaacaactaacatataattcctcctctttaaaattctcacttattttatactagttaataaatgatttgaagatactcataaatttatgagtatcttataaatttgttttatattctagataggaatatatagattttttgtttccatttgtatgcacctatacttataaacaactttcattgcaaatgaaaaagcataactgataatttcagaataagtcctatactaaaacttaaacttaataaaagttatgcttttcttatgtttaattttatctttaaaaattaaaattacgttgattttatcactatttatttcttagtttcatctgcaggaacaagataacttcttgaatagattcttgaccagttaataacacgacaagtctatcaatacccatacccattccacctgttggtggtaatccatattccaatgcttctacataatctaaatccgctgtcttcaaaagtatatttcctctttttatcattctcttttataataacttctggatattcaaattcattatcatccataaactcgtcaagctgatcttgattattaactcttgttattaatttatcatttagatcataaatctccatcatacttttatccccaaaaaacagttttttataacagcaatacggtatttatgatattggaaatgtatttttacataagatattttcttttgaatacctgaatttttccataaaaaattgaattcatcattacaaatctgttcgcattttacgattttttcaataatcggtctgcactcttccttcatttttttatatgagcaaccgccttgtcattcgctctacttaattttataagataatcttacagtttattatatagatcttcattcataaattcgctaaaatactgacagtttttcacgtctataatatttattaagtttcttgctataatttctctgtctctcacaataatcactatttaatattaacgcatatattttaataatatcaaccactctttaatcattaactatactgttttcttgatatttttatttttataaatttgaataaatattgtttttgctatcagtaagcgaaaaactttaacaaccttaatacaaactaaccaaatttatttgctaaaaattttaaaaaaaatatttattattaatatagtcaaagctattttaaataaagaattaaaataggacacattataatagcatattcaaaactatttcacatccaaaatctaaaaaatgacaaactataccttttctctacccatcatttttgatgcaaataccttatcaggtacattttcaatagggatagcagctcccgtcactggagcatacaatacaacagattcttttttttaacaaactaaacattattctaacctccaacaaaaaaactctctgtatgcaaaacaaacacaacaatagttatatttagtaatgcctcccagagagtaacaatctttttttattttacaagtatattaacaatttctataagtgttgtcaatggtaatcttttaattggataaaataatcttatttaaattgctaatcttttaacaataaaactgtttttattccttcttaaggcaacgttatttacaaacattcaccattgctctcaattacttttttataccatgcaaaagatttctttttgaatctttgtaaagttccttttccactgttatccttatcaacatatataaatccatatcttttattcatctcaccagtagatacagaaacaatatctataggtccccatgttgtatatcctattacgttcacaaaatcttcatgtattgccttttttatctgcattatatgattacgaaaaaaagcaattctttcttcgtctataatctcattattgctatcaattttatcatctagaggaattccattttcaacaacaaacagtggaacctgataacgatcatataattcatttaaagctactctaagtcctataggatcgattgttcgattccattgtccagtttgcaaatatttatttttcttatcaataacaaattgattttcgtcataacttactacatatgtaaaataataactaaaagcaatgtaatctacttttcctttttttagtatttcttgctcctctttgctaatagtaagatcaactcctagacgctttaattgagaataacaaaggcttgtatattctcccttaaccattacatctgtataatagtaattttgaatattataaaaacgttttgctaatgcatcatttggatgacacgtttttgtataagcaggtgtatactgtatcatacatcctatcttaaaattaggatttatacgatgtcccaaatccactacctttgctgatgcaataaacatattatggcttgcaataacttttactttcttatcattctcatcctctttaaattttaacccggcctgcaaaaagggatcttttttattcatcgtttcattaatttcattaaatgtcatccaatatataactttatctttatatcttttaaaaaccacattcgcatattttacataaaaatcaatcagttttggatttctccaagaaccataagcttccaccaaatgtaaaggtgtctcaaaatgcgacaatgtaacaataggttgaatattatattttaacagctcatcaaacactttatcataaaattgtaagccgcattcattaggaatttcatcatctccattaggaaaaattcttgcccaactaatcgacattcttaagcatttaaaacccatttgtgcaaacaaagcaatatcctctttgtatcgatgataaaaatcaatagcctcatggcttggataatatactccctcatgaatcttttcatctacttgtctagggattccttgctgtgatccacgtacaacatctgctatagataatcctttcccatctaaattatatcccccttcgcactgatttgctgctaatgcaccaccaaataaaaaactttccttcatattcatacctcattttccttatttaaaagtaactccgattctgtttttttatttgaaagtataacaaatggtgcataactcaaaaaacctataacaagaacaactacagttaacaaaatagcttgccattgcccactaaaccctaaaaattgttgaataaacataggcatacctgctacagattccacataagatgatactaaaaatccagaggtaattgcataatatccgatattagcagtaataagcggtaccaatacaaatggtattaaaaatataggattcagcataatcggtaaaccaaaaaccattggttcagaaattccacaaatcaatggaatcattgataattttgtaatatctttatactcttgtcgtttagagaatactaaaatcgctaaagctaaagaaatgacaatccctgaaccacctaaatttgtaaataagtgaacatacgctaaagtataaaactcttcaggtactaacccagcagacactgcagcaatatttgccgctaaagctgctgtacgcacaggcttcgcaataacattcattgccatatgtccatgaattcctgtccaccaaaggagttgtgataaaacaacaataatactaacacctatttgagacccaataatttgattaaatggtacttgtattacattatagataattgtattgatatatagtcctgtagctccataaagtgtccctgcaaagataccaaaaacagtaattgtaatccaagcaggtatcaaagaattaaaactacgcgctatcataggtggtactgaatctggtaattttatttttattttttcaaatctcataagattaacaaatattagatttgataaaatagcaacaaaaaaagccaaaaatagggctgatgcacctaaattacttaacaaattttcttgatctgacaccactaaaaaacatactgtagtaattagcgctgataataatttattttgcttctctcctaattgatatcccattaaaaaaactagccacaaagccatacaggaaatacaagtaaaatttacagtagagaatatctttgaataattctctaaccacgctaaaccttcaaactgtgctaaaccagttttagtacaaacaaaaatattaaacaacaatgcaaacgaacctacaataataactggcatcattatagaaaatgaatcacgaattgcgcaaatatacttgtttctattcatataatttgtaattggcattaaaactttttctaaaatagtcgtaaatttttctaacataactcataaccttccctttccatctctatttttaaaaaatttcattttagtactacttaaaaaaacctccttccatgacacattatttcataaataaagaggttttattattagttacagttaaattttaacagtgttcatgcatttgccattttttttgaacaaaaacattaacactgttcatttttctcacctaaatcacttaaaatgggatttgttgaatacctgttaccttccaatttttgagtaacagctattttatattcaaaattctttttataattcattgaaaaataagctgagtagagtatatcaagtataaaactgatagaaagattgctattaaagttagcaatattatgttttaaattttctctagttgatatgtgaagacagacattagccatacgacttagtgtattttcaccataggatgtcatggctataatagggatacagcgttgtacacatacttcagccatttgaatgatacttattgtttctccagaataagaaataaaaatagcacaatcttgctttttaatacaatatacatcatatctttgataatttgtattactaacaatatacacattctttcctattttcattaatttttctttaaatgattctgctatgtttaaagcagttcctttagagtatatatgaatattttctgattgcatgagaatttgaatagctttttgaaataaatcatgatgcagtaatgatagtgtatcatctatcgtctctttataaagtattcctaatttatttgccaccctatatatagagtctccatctttaaaaggtacattagggtttatcattccatattgcctatttaagtattctaactcctctaaatatgtatctttaaaattttgaaaaccagattttcctacctttttacataaatttaaaacagtagcaggcgaattatatgtttctttagctattcgtcttgctgaatactcttttatattttctcctaaataaattatgtaatcagaaataatttcctcactcttagaaaagttttctttctttgttaacaaatctactaataacatatatatcaatcacatccttctatttatattatactaattatattataataaacaaaagaatattcatatagatagccattattatatatacttttgtacaccaaattctttattttttctatacgtactatcattattctctgtattactaaaaagtacagagcaatgtaaacagtgtcgagcatttttctaatgctatctgtgaatgctttattgaaacatgatgtctcaaaggaataatatcactatagtcatgtatatctctcacgctttatgtcctccgatagtattgtttctgtctttgccagttgctccttctactagatttataccttttaatacagcgttttttccatatttctgcttcagtttcaaagttgcctcctgaagtcttttttccttttctaaatctttttcaagcttttcttcttctttttttaactgctcgtaatcagtaaacagatccatttgctgtattgtcggttttgttttaatactgctttcatcagtaatatgattagcagacaatgcaaaacgtcttattgttaattttttattaacactgctgtcataccagtttaaaactttttgtgtaactagctttgctgatgatgcatatctgcctatattgacagttccatgagcatgttttggaatctttcgtccacatctgtcatcctttatttcaccactatagtcagttttgatgttttctttatcatagccaacacttatagtaatctgatctgttactagtttttttgccacaagatcgagacacaaaacagatctacatccagctgtagtagattatgttaaaacacaaatgaaaattagaacagtcaaaactaattatacaagcgaaagtgaagacgcttatgaattaggggtaaaagatggaagtaaatataacttgaataatggtaaggaatcaatatcacggattgggtaaatataaatggtaaaattattaaaaaaattaatattaagaagaaagtgtaatgtatgtggacatgttttatgtaatgaattaaatgtgtgtcctaattgtggtagccaacttcataataaagataagagttctaaaattcatttaaatgaaaatgctgaggcaataattcttattacattaactattctagcgttagttgtatctattgtatttgttatttattactttaagttattaatatacttattaaatctgttattcaatacccgatttgtgcaaacagaccctacatttgatatcgtattttatttgattatggaatttttatcaaaattaggagtcagcatttgtgttatttgttttagcatagttataattccattaattttttcaacaatactttatttactatttgaactagtaaatttgaaaatagattttaaattagaagaactaccagagggtaatgagttataaatataacagtagtatatgtttgaaaaggaaataaaactaacaagataaatggaagtataaataaatcaactggtcagatatgaccagttgatcagggataaactaaagtaaataaaaatacttatgattataaaactttttgaaaaagttgcttatgaactgtttgaagaaagaaattatacttgactgtgggaggaaatacaattaatgaagttcaaaaaatggaatataaaatatgaatcaataaattatttaaaatgttatagcaatataaaaccatcaattggatcacaagtgacttttataagagaagaatcattattgatatgtatcttaagatattggaaacgactcttcagttatattagatttgtgctgttacagtcattttgtattgtaattggtatgtttgctattgcaggatggatgaatttagaagcctcaataaatatttataatcactctttatatgaattactgaattttatgtctgttatatatattggctggtgtatttttagtgttggtattgatattgttaaaaatatgtggaacgatacagatagctttctcaatgatagacaattaaaattaattataactatttgtatttttgaaataacgaaactatttgttaagaataaaaagctaacagtaactaatgtttttaagtgcggtaaatatagtttttttgcgggaattatatgctgtttaattcttttaattatttttattatcaaatttatagtgcaatataattctgatgatataaaaccaatagaatgaggatatgattatggatgatattacaaaaaaacattttatacatttaagtctagtagctgtattttttagtctattgactataatcggtattagcttgaatgtgtatttcaccgttattgttttagtatttttaatgatattatttttgctctggtttttgcttgatttttgtcagtcgccattagaggaaaaatgtttattagtgtttctaatttgttactttatattaaaaataataattttgttttattacaggtaactgaacagtttcattaaaaaatgtgcaaaggaaagtgagtaataaaagtacacattcataattcaattctaaacaaaaatagcgaaaggaaaaggtatacaaaattgacagttaaataagtcgatttcaatataccaggaatgataaatagtgttaatgaaaataacaaactggagaaaaagtgaatttcaatatcttaaagagaggatgtataggaagcagctagaagaaaaaattgatttgtataatatgtattcagatgtgctaagtcataaagaaaagaaagaattagagaaactgaaaaatgaaaaaggtcattttattgtgattggaaaaactgtaaaatcaaagacattctttcagcataaagaatatctttgaattcttaattagttgtttccgttttttaccgttttgctctttataaaaaaataaaataaaattcattagttatataaatagcaagatctaggtatttgataaacaggcaaataataaatattgaatgttaacattgttaatgaatttgatgtagaacttaatgatgtaatcaataaaattaaaaattcttataaaaaagagatatagaacaatgatgtcaactgacaaagttgatgtagtaaaaagaatgaataaggaaggggcatataataatgatagaaactacaagtgtaaatctttgggattatattataggcttttcaattattttgatggtacctctaataatactaacagttttttatatgatatatttaataattaatataatagaaaaaaaattacaagaaaacaatgaaaatagaatgtacttagtagctcttattttaggttttatctttttaataattgaatgtttattatgcaaaggattggtggatctgtttcaaattttttgcacttagtttccagtttgttttttagtaataactcaaatgattatacgaaaggtgaaggaaaattatgaatacgatgaaaataattaaacttatgaaagaaaaggcaaaagaggtaggtatgaaagttagttggatattaaaagttagcagctttagagaactgttaaatgtgacaatcttcttaatgtcagtatggaatattatatctatttttatagacattccaaaaccgtattctacatttataagcagtattattttattaacagttacgttgatggaagtctggctgttatgccagaatgaagaaaaataggaaaaaggtatattgtaatgataatcaaatgttctttttatgctgatacttgaaatactaagacattataattaatccgctatttttaagtatgcaaaaaataagaatataggggggaggatagtcatgaaaaaagaattgcttgaaataaatgaaatggttaaaggtgatgaaatagcagaaaaaattatgagtgatttgctggatggttattataaaagagaaagaattggagagtttagaaaaaagctaatacatttttctgaaccattattaaatataattgcagcaacattatttttattgatatttttagtactatcgttcaatataggcgagagactaggtccatattcgttaatcccaatactatttgtattttctatttgttattttatgttttggtatttgatgatatatatgcttgaagatgtgaatgataaaattaatgagaaatacttttataaaatcaatgatgatgaactggattatataaatgacattttgtatgaacggaaagaatttaagaaaaaatatgagataataaaaaaaggaagcaacaggtatatagattatccaccattaactaaaatacggaaaaagaaaaaatgcaatgagttagaaatttatagttattatcatattaataagatttcattcgatgagattgatattgattgttgtgaatgtaaaatatggaagtaaatagaaataaaaatttaaataaagtaaaggttagtgtttatgaaagattaatccgctatttttaagtatgcaaaaaataagaatatagggggatagttatgaaaaaagaactgcttgaaataaatgaaatggttaaaggtgatgaaatagcagaaaaaactatgagtgatcacttaaaatatcttcaagaaaaacgtgcggaagtgttaaaaaaaattagaccgatatgtgaggcatttggaatagaagattatgattatattgtcagtgataaaggagaaacagaaatattaagaataggaactacaaaaataggatgttcctggaattctatagatgctgttgtacaggaattagtaggttacttgttcgttgtttattttagagaaagagcattagggcactttaaaacgcaggtatttaatgaaataaaatgttattggcttaaataataaacgtaccagtgactggtacaaatgttaaaggtgaggtgattgggaaatggaaagaatttggggatgaatatgacaggataattgcatggaaaaacattccagaaaagaaaattgccgataaattaggctggctaaaaaaacaccataatgaattaaaagtggctttcaattatgatgttgaagttaattatgattattttgaaatagcagaatctttaactgagtgtctttgtgaatatccatattttttatggaatgaatatgttcgttatatagataaggtttatgttgtaataattttttaatagttttatttcaaatgttgaaatatatcatctttttcctatcagttaataccttgatcgtttaataagtatactggtcatatctgaccagtaatgactgaataaataaaaatatataagagagagaaagaggtgaataaacacgaaactagatgatggaaacacaaatataatagtaaataatcggatggaggatgaaaatgaatataaataggaaaccaaaagttatagatgttaaagcaatgacaaaaattggacaactgatttgcgaagattatagaccaattttagaattatcaagagccaatatactaaacgacgactatttcaaaacatcaagtattattagagtatctactaatccacccttaaattctactgaagaattgtttttagcctatataaattataatccagaagaaccggcatctgagtttttacgaatttgtaaagagataagaaaggttgatattgaatgtgaatattatttaatttttcactacttttacggtaaaaccaatgaagaaatattatattcagacgaattttgtggagcacgcagaagattttacaatgttagaaataaagcacatttacaggttgcctatctaacaggaaatatcatctataaaagcactagtgaaataaaagtgaaataaaagtgaaataaaagtgaaataaaaatgaaataaaaatgaaataaaagtgaaataaaagtgaaataaaaacgtgattgaaatgtgcaacgaaatgtgaaataatgctattaggtaaaagtggctaaagaagcagaaatcaatttactaaaaggcgttatttcacagtaacgcttttttggttttaaacatttccgcctctttaaataaacagtagagagtttttatagttttctctcggcggatttataataaagggtgaccacctctcccgtcacccttgctattatatatttgtaaatgaaatcatatgtttattgatgaaaaataaataaaataattatataattattttgtactaaataaattattaaaaatattctgtaaaatttacaggttatttaatttcaaagttaagggagagaaaaatacatatgatagactatattattgattttattcattatataaaatatagcaggagtagttttttaagaaaggttttgattacactgctgtttataggagctattgttatttctttatgcgggattctgcttgcagtcttattatggctcgtattatcactactgcggtatattataacatttgtagaaatatacggcgaatatattgctgcaattggatttttactttttgcaatatgtataattctaattatttcatcaggagacagctttctagttcatttagatgctttaggatcactgctgcttgttgtatttataccactgtacattgaattaatagaagagcttctagattacatgataggcaaaatgatgaatattaaaaataaaaataaaagatacgtgttattagataaagttttaaaaatgtaaataaaatagttcgggaggaatagatattatgaaattaaataatttacttgatacaaaaaagaaaaagattatcgcaggagcgtgtaccggtatactgattcttggcggtatagggatttatgctttatcaggaaacaacggtgatttgattttaacaaaaaataaaattactgctgaattaggacagactgtatctactgatgtggctgactacctgaattataataaaattgattcaaaaaaagcagaaaaaatcattaaagacactaaaacaaaaaacaacttcaaatatgttactgttgaaaataaagatgaaaatggtaatgtaatttctaaggaagaaaaagactttcccgaagtcggcaagtataaaattgattttaattacaatgacgaaaaagaaacagttcaagtaacggtcgaagatactactaaacctgaaatcatcgctcctgatacaattgatgtgattcagtatactgatctgtctacatttaattttgctgaactgttgcaggtaactgattatagtgatgtcgatgactggcagatcgatacttcaaaagtcgatgtcaacacattgggaacatatgatttaaaaatttctatcagtgatgttgaaaaaaacaaagctgaaaaagaaatgaaaatcaatgttgttgaagcaccaattgtagctgaaggtgaagtagcagtaactgaaatcgtaactgatgaaaatggaaataagaaaacagttgtaactaagaaatcgagcagtgaggtaagttcaaaagataacgttacgagtggtaagccagtagaaaatacagataaggtagaaagcggttcaggaaacagtgcaactaaaccgtctacacctagcggatcaactggtggcaacactaacggaggaaataacagtggaaacacaggagataataaacctactcattcacatagctgggaagcggtgacgaaaacagtacaccacgaagcagaaacaaaaacagttcatcatgatgcagtaactaagacagaaacagtaacagttgtcgataaggaagcatgggatgagccgattcttgaaagtagagtaatatgcaataaatgtgatttcagtacaacagatgaagatgaaataatggatcattctcttaaagtgtgtaaagttggatggcatgtcgggaaagttcaaattggaacaaagcatcacgatgctgtaactcatcaggaggaaagaacagttgttgtgaaacctgcatgggacgaaactgtaattgtaaaacctgcatgggatgaaacagtaactaccggctataaatgcagctgcggtgctactaagaacaagtaattaaaatagaataacaaggcaatcgaaagattgtcttttttgttggaggaaagcaatgaaaaaagtatatttatgggtattcgatacatgagcagtcttatgactgctcattattatttgacggttgatcaattgcctgatcgtaataccgattttaaagaagtatagtgatgcttgcttattaaattaaatatagtatagaaataatctttaagctgtaacttgcatcacagaaaatatttttaacgaaaggaataggtgcaatgaaaaaaattagtacattcttattatctgtactggtgctttttggtatggctgtcaatgacatgtcatttgttagtgcgatgaatactgaaaaggtcactttaacttctgaaaaagaagaaatagagacagatgaaaaaacaaatcttaaagctcatgctgatttgccgaaaactgctgaagtaattgattataagtggacaagcgacaacgaagaaattgctattgtttccggtgaaatgaacagtgcggttgtagaagcaaaagcagctggtaaagctaaaattactgttactgtaaactacagaaacaaagtcagtgcagaagcgcaggaaaatataaattcctctactgccgaaattgaaattaatgtagttgaaaggaaacctcaggatatagttactgcaaaagaggaatctgatgctgaagcatctgaaaataatcttgatccagtaactgctgaattttagatttataatctgaagctgaggtcggaagcaccatctatatttacaaagtaaattaggtggtgaggttcacaatgataagattatatgctataactgcttatgaatcggacattattgtgtcacaatgaaaaaaggtaaggaatatgttccttacctttttaatttttagaatgagcttaaaatatatatgataatttaactgtacgagttgaaaattgtaaaatagacgtaaaagctgaaccatctaaaagtgagtagttcagctttttatatatagaaaagttaattaaacggttaactttctttattataatcatgttctgaatttgtaaaaagaacaccataatcaaacatttttaaacttaaatactggagaatatcaaaaaaattagaaacaatacattctacatcctcatcttcttgaaccccaagcttactacaaatacgcagattggcatcaaatatttcttgatatgctactgcacacttgctcccaatagtaaattcgtttttaactttttcactttccttacaggaataactgctcaattctatgttccctgtcatcaaatcataaataaatattttaaatttatcactatttatattcataatctttcccctttgtttttgtataaatagtgtccttataagaacactattagtaaatatattttaacgcgataattaatgttgtgcaagataataatacagtgaacggggtagacatatgataaaatacgatagactttggaaaacaatgaaagaaagaggaattactcaatatgacctttatacaacttataatgtaaatcgttctcaaataaatcggttaaaacataacaaaaatgttgaaataaatacaatcgataaattatgcaatattcttcattgtagagttgaagatataatggagcattttgaggacaataatatattttaaagaaacagaattttaatttttatggatttctgttacttaaatttaacaaatataagcatggtgtactgtattcaaatcataataaaaaagggagcaatattgttccctttgactataatttataaattcttatttatcgcgagtttcagtagtatcattttcgcataggccatttctaacattcttatcataatcttgaatattttttattatttcagacatatatttctcttcatctctattaaaaataaactccacaatcttagttggaattattaataaagtacttattagtgtacctgaagcagtaacaaacgcaactaaagttgttatattgaaatccttattaaatataatatatcctataaacaataataaaactaatatcactattcctaaaataatcataaaaaatataactacaaattttcttaatttactcttaaaatttaaagcgctatctaggtacagagtgtatttttttaaaattgaagtatattgtttatttctttttataatatgttgattatcgtttgcatctctataatttttatcatatcgaattggatttacttctactgaatttccttgctcttttacagaacgaactatatcattaattatactaaagcttgtattatggttactcttactcatttattaatttaatcctaattctactattctttttgaaacagcagtttcagaaacttcaaattcttctgataatgatttacaaatagacacttcatctagtcctaaagtttttctagctgtgtatttgtcaataaagatatcttttggcattaaaagagcagctgcaaatctgttaactcgcatttctcccggtaaattaacatcatcttcagccaaactataagcattagcatattcctcatgaccattgtaatcaaaaatatagtgccctaattcgtgggccattgtaaagcgctgatgtccgcgattgtctttagaatttatttgcaatatttttttacttcctaacattttttcaaattcttttgctattcctattcttccagacaagttatcatccatatcaagactaaatattttaaaacctactttattaagaatattagcaatctgtgtgggagtttcttttaatccaaacatttccctaatttctgcagcgataatttcaattttctctacattgtagaaatctttaaaataattatttttttttctcatttcatcaaatacacacatattaatcacttctctacttttcttatacaaactcaacacctctatttaaaagcataacaaattttaattatataaattgtcacattatgttactaaagcgatgttgttatgacaacctttattggtgtttcttatattttggtttatttaattttcttagagaaactcctttcaaatagattttatcacagtttattaaaaatagtataaaattcatcaaaaaagttgaaattcgacatcataattaaaatattttgtagaaaaaccggtcattaatatgaccattataagtattttgtaataatatttatgacaaactacatttgcatttttcaactagaactccatagattaaccctatattaatttacttacaagtgtgatgtttaatgaatatcttccaaagatttatatacaagtatgagaaaggaaaaaagttaaaaacaatataggttattactgagtagatgaagattgtaattcttatggaataatttaaaaagatagattacattcgtcaaaaagcgaaagaagtcgttataaagatgttattatcgcagagatggtatatattactgaaaataaaaattcaggttacttttaagaaatattgtttttagaaacaattctatgattccgtttctacatagtcgaaagtatgatatgattatcataataatacatctaaatgaacggagaatataaaatgaaatgtatatattgtaattctgaaactgaactcacatcatccgatataataacatatgcaattacgggagcaaagctaacgaaatcatttgtatgtaaaaaacataacgctctgaccaatgataagtacgagaaacaatttgtttctgatttagatttttttagaaaccatttgggtcttactactcgtgatggaaaacctattcagtattttgcagatatatcagtagatggaacagaaatgtataacgttaaagttagtaacagagaatccttctacgcaccaaaaaaggtagttgcgggtgtagatgaagaaggaaacaaaattttgatggcaactatggaaaaattagaaaaaattgataaagataaatcatttactgttgatataagagatgttacattacacaaaaagatttcttcagacagttttcttggtcattatgcagtgcatagtattgccaaaatggcgtatgaatggtattgctatataaacggaatagaagaatttactgaagaacataatgaaatcgtcgaatatatcttgggaaataaaaatggaaattttgttgatattataatcgacagaaattattatatagcaatagacgatttgtctcagatagggacaaatactttctttcaatatgatgatattgatggatatagatatgttgtatttgatttttggaaaacagttgcgtatagagtaaggatttgtaaatccctaaagtataatattggttgcgatatgaaaccagtgatttatcatttgtatctgtatcacatagatggtagtaaatcttcagaagtatttagtagggagcactattttgatagtaaaaagcctacatttgaagttgttcagtcacaaaatatgaccactgaacaaatgaatgtatttgcaaaacgtaccgaaaaaatactctcaactatgattttgtctattaacttcttaaagaaagtagtagataaaattacttttaagcttgggagctatgatgcaggaaaaataaatgttgctcaattattagaatttgaagacaataatattattgatacgctagaacttataaatcggttatattgccataaagataaatacgatgttacaaaatcattcaatcaaaatttacggataatcttaaagctggatagtgatactataacgaaaacacaggaagaaaaaaaggaatatataaagtccttaatggcgatggataaagaaaagcaattatctgattatatatggaacggaatacatgtgtttaatgagatatacgaaaatgaaataaatttaacaaagtgaaatattttacatagccgagtagttttcttaaccgaaaattcctcggctttttctatttgtgagggtggcggaattaaaagtaaaaacaaaagtcactaataccccatagttttttttgaattgcttactaagtagaaaaaatggtagaggtatcatgaaagagttaaaatcggaatataccttggatattttatcacttttttttataaatataacataagactaaaaattaacaatctgggcaactacttattatttttggcagcttttttatttacataaatatttgtccatgtatattaattcatcccaattgattatacaacgtgttctgttactcaaaaaggaaagagtgtggagtacagttctatcaagagttagaaaacctacatttgcgtttccatgtataattgtgttctatttctttgttttcacaaagaataatttatgttaatatctatttgtactcatataatataattggttaaaataaccaataaagtatttatagaatttgtttctaatattttattaaattaaaaaactcaacctgatgtatttcctctgcagaattgaaatattgttctagaatttggaaatatgaaaaaaaatatttggaaatagcaatatctccagaatagaaagttgatatatatagaaaagatggtgttggtaacaatgataaacgctctgatatatcatatagtctagattttattaaacaggaagtgaattggtttgaaagttgaattttcaactacatgaaaaccctagagtagttatattaatgttttagtaagtatctagtgatgacaagattatatcttgtcaaaataaaattttggcatacaaaaggggaatttttaatgaacaacaaaattatatttacaacaactaaaaaaaacttaatcattattggaatagctttaattattgtggtaataggtatattggcttatcatccaattaaagagatacttaatcctgtttatgagccagaagaagtcattgatattttagaagatgaattaaatatcactatcttcagttttacaattgtagaaaatgaaaatgacaatacacatttagttgatatcgaatttcagcaagccaatgaattgcaaagacgtacacttgttacaccatatttaaaactaaataaaaatacaattgaatattttgaagataaaatttttgaaaaaataggtaaataaatgtaagcgtcaaataaatttagagaagactagaaagagcctagtagataataaatctattaggctctaaatactctataatagaatgggtatcatcccatacaacctatacaataaaatagttgataaatgtataagatttttttctttttattttaattgacccggtgaaaattctggattaattgtagccgggtttcttaaatatttctggtatatctacattttggataattacaacatcctaaaaaacgatttccagcatttgcgcctctagttgcagttctcaatacaagaattccaccacaccttggacatctaccattttttacttcatcattcatcatattaaatgccctgatagactctgcagcttttttattttgaatattagctatatgccgatttctttcgatattgctaatttgtgtgtagggataaagcttattataaatatctataatgtcattttctgttaaaacatcttttaatacatcttgatagatatttgacacaatatatgatgcctgattacgtttaattactctaatatcattattctcaactgtaattcttttcaaagtgcatctatcagaaaatacaatgattgagtgcattataatttggttcccaactaaagatttaagatgctttatatgagagctattttgcataataggattataaaaatgttctttgcgacttctacctctgccagtagctaaggtttgataccagtatttttgattttcacttccaaaaatccatccactataatttttactttcgaatacaaatatccctcttttactaatcattagcacatcaatctcagttttttcaccgttttgttttggaatataaacattaaatagaaatttagctccattttgttcaaaaaactttaaattttcatatataagatattctccatatcttcctaaatcgcgttttatatagaaaaaaggaaccttagttatctgataatatgcacctgctttatagtctttatttttctttaagtatagaataattagaattccaagcagtatcactactaccatataacgcacctcacaatttctttacaattataatgattttttcactaataaactttttgtataacttttttaataatttaagaaattacttatcaccaaaaagtgtttctatgataacatcaataatcacaaaaagcaaaagtggaccattaataaatcaaaggcacatttatcagaattacatcactacaatatttacatttaatgctttatatgctattatttatatacaataatatagtcaggggtatatgaatgagaaacacactgacggtaaaaaaggtgtgggtgtggtgtgggtgtggtgtgtgtgtgggtgtgggtgtggtgtgtgggtgtggtgtatatctatgtcaccttattgcatgctggatggtgttagacaaggccgtagggacatatagcatctaggaagtaaccttgtacgaaaataggcaatatttcctgtttaggcgattgtgacgcagattttagtccaacgatctagcgtcaaggaatttttttatagtgggacattgcaccaaggaagtaacttgatacgtcgtgggtgaatgggtctgttttcttattcggcggggtaatacatttttgggggaagtttgtctgtctgacgcgccatatgtaggtacgccaaaaagggctcctctacttcgaagcgcgaggtcgtatacctaataaggaaatgtaatttataactttctattatattggtcttttcgagagcggaagaagttgtaggctaagcgcaggctaagcgtaggtccatgtttaaagtatccaagagaatatccacgaagcggcttgagcaacgaacagaatcctggttctcctcgactaagcagatagttaagatactgtgcaccatggaaattgaaaacgaacgtacgtaccgactactttatttttgcaggccggaaatcaagcgatgaatgagacatccttctgttttctatgttgggacagacagtcgcttatcttagtgagatttcttattaactgaattttctttgctgctgctggagatttgcacctgcatagcgcagattctgcatcttctcaatagagtagcttaattattacattcttagatgatgataagacggaaactggacaatcttttgtttatattgatggatttcttgtcaaaaagcataacaatcaacatactattgttaatttcgaaacttacaaaaataaaatgaaagtttccgataggcgtaagtttgaaaaagcaaactttgacgagtttgagtcggctctaaataacaaaaacgacttggtacattgtccctcaataactttatttgaatcgatccccacggaagtgcggtcattctacgaagacgaaaagtctggcctaatcaaagtggtaaaattcagaactggtgcaatggataggaaaaggtcttttgaaaaaattgtcatttccgtcatggtcgggaaaaatgtacaaaagttcctgacgtttgttgaagacgaaccagatttccagggcggaccaatcccttcaaagtatcttattcccaagaaaatcaacttgatggtctacacgttgtttcaagtgcatactttgaaattcaatagaaaggattacgataccctttctcttttttacctcaacagaggatactataatgagttgagtttccgtgtcctggaacgttgtcacgaaatagcgagtgccaggccgaacgacagctctacgatgcgtactttcactgactttgtttccggcgcacctattgtaaggagtcttcagaaaagcaccataaggaaatatgggtacaatttggcaccccacatgtttttgttactacacgtagatgagctatcgattttttctgcataccaagcaagtttacctggcgaaaagaaagtcgacacagagcggctgaagcgtgatctatgcccacgtaaacccattgagataaagtacttttcacagatatgtaacgatatgatgaacaaaaaggaccgattgggtgatgttttgcatattatcttgcgagcatgtgcactcaatttcggggcgggtccccgtggtggcgctggtgacgaagaggatcgatctattacgaatgaagaacccattattccctctgtggacgagcatggcctgaaagtatgtaagttgcgcagtcctaacactccacgaagactcagaaaaacactagatgccgtgaaagctttattggtgtcgtcttgtgcttgtaccgcaagggatttagatatatttgatgacaacaacggcgttgcaatgtggaaatggatcaaaattctgtaccacgaagtagcgcaggaaaccacgctgaaggactcttatagaataactttggtaccttcttctgatggtgtatcagtatgtggaaaactttggggagagttgaacaactgcttccatgtgccagcctcattttgcgtaatcgagaagttttgttcagagagccaaagcgaggaattgacgagtatctggaaaacgattcttttcttcaaatgatacctgttaaatatcgtgaaattgtgctgcccaagttgagaagagatactaacaaaatgaccgcggctcttaaaaataaagtcgctgttgcaattgacgagcttacggtgccacttatgtggatgatccattttgccgtaggatacccttaccgttatccagagcttcagctactcgcttttgccggtcctcagcgcaacgtatacgtcgatgatacaacaagacgcatccaactgtacactgattacaacaagaacggttcatcggagcctcgacttaagacgcttgacggactcacttcagattacgtgttttattttgtcactgtgctaaggcaaatgcaaatatgtgcgcttggtaacagttatgacgcttttaatcatgatccttggatggatgtggtgggatttgaggatccagatcaagtaacaaatcgagacatttcgaggatagttttgtattcctacatgtttctgaataccgcgaagggctgtctggttgaatacgcaacttttcggcagtacatgagggaacttccgaagaatgcacctcagaagctgaattttcgggagatgcgtcaggggttgattgccctaggacggcactgcgtaggtagcagatttgaaacagatttgtacgagtcggcgacgagtgaactcatggccaatcattccgttcaaacagggcgaaatatttacggtgtggattccttttcgttaactagtgtcagtgggacgaccgccactttattgcaggaacgagcttccgagcgctggattcaatggttaggccttgaaagcgactaccattgttcattctctagtactcggaatgcggaagacgtagtggcaggtgaggcggcgagttcagatcatgatcaaaaaatttcaagagtaacgcgaaaaaggccccgagagcccaagagtacaaacgatatcctcgtcgcaggccagaaactctttggcagctcctttgaattcagggacttgcatcagttgcgcttatgttatgaaatatacatggcagacacaccctctgtggcagtacaggccccaccgggctatggtaagacggagttatttcatctccccttgatagcactggcgtctaagggcgacgtgaaatatgtgtcgtttctgtttgtaccgtacacagtgttgcttgctaattgcatgatcaggttgggccgatgcggttgcttgaatgtggcccctgtaagaaactttattgaagaaggttgcgatggcgttactgatttatacgtggggatctacgatgatcttgctagcactaatttcacagacaggatagctgcgtgggagaatattgttgagtgcacctttaggaccaacaacgtaaaattgggttacctcattgtagatgagtttcacaactttgaaacggaggtctaccggcagtcgcaatttgggggcataactaaccttgattttgacgcttttgagaaagcaatctttttgagcggcacagcccctgaggctgtagctgatgctgcgttgcagcgtattgggcttacgggactggccaagaaatcgatggacatcaacgagctcaaacggtcggaagatctcagcagaggtctatccagctatccaacacggatgtttaatctaatcaaggagaaatccgaggtgcctttagggcatgttcataaaattcggaagaaagtggaatcacagcccgaagaagcactgaagcttcttttagccctctttgaaagtgaaccagagtcgaaggccattgtagttgcaagcacaaccaacgaagtggaagaattggcctgctcttggagaaagtattttagggtggtatggatacacgggaagctgggtgctgcagaaaaggtgtctcgcacaaaggagtttgtcactgacggtagcatgcgagttctcatcggaacgaaattagtgactgaaggaattgacattaagcaattgatgatggtgatcatgcttgataatagacttaatattattgagctcattcaaggcgtagggagactaagagatgggggcctctgttatctattatctagaaaaaacagttgggcggcaaggaatcgtaagggtgaattaccaccaattaaggaaggctgtataaccgaacaggtacgcgagttctatggacttgaatcaaagaaaggaaaaaagggccagcatgttggatgctgtggctccaggacagacctgtctgctgacacagtggaactgatagaaagaatggacagattggctgaaaaacaggcgacagcttccatgtcgatcgttgcgttaccgtctagcttccaggagagcaatagcagtgacaggtgcagaaagtattgcagcagtgatgaggacagcgacacgtgcattcatggtagtgctaatgccagtaccaatgcgactaccaactccagcactaatgctactaccactgccagcaccaacgtcaggactagtgctactaccactgccagcatcaacgtcaggactagtgcgactaccactgaaagtaccaactccaacactagtgctactaccaccgaaagtaccgactccaacactagtgctactaccaccgaaagtaccgactccaacactagtgctactaccactgctagcaccaactccagcactaatgccactaccactgctagcaccaactccagcactaatgccactaccactgaaagtaccaacgctagtgccaaggaggacgccaataaagatggcaatgctgaggataatagattccatccagtcaccgacattaacaaagagtcgtataagcggaaagggagtcaaatggttttgctagagagaaagaaactgaaagcacaatttcccaatacttccgagaatatgaatgtcttacagtttcttggatttcggtctgacgaaattaaacatcttttcctctatggtattgacatatacttctgcccagagggagtgttcacacaatacggattatgcaagggctgtcaaaagatgttcgagctctgtgtctgttgggctggccagaaagtatcgtatcggaggatggcttgggaagcactagctgtggagagaatgctgcgaaatgacgaggaatacaaagaatacttggaagacatcgagccatatcatggggaccctgtagggtatttgaaattttttagcgtaaaaaggagagagatctactctcagatacagagaaattatgcttggtacctggccattactagaagaagagaaacaattagtgtattggattcgacaagaggcaagcaagggagccaagttttccgcatgtctggaaggcagatcaaagagttgtattataaagtatggagcaacttgcgtgaatcgaagacagaggtactgcagtactttttgaactgggacgagaaaaagtgccaggaagaatgggaggcaaaagacgatacggtctttgtggaagcgctcgagaaagttggagtttttcagcgtttgcgttccatgacgagcgctggactgcagggtccgcagtacgtcaagctgcagtttagcaggcatcatcgacagttgaggagcagatatgaattaagtctaggaatgcacttgcgagatcagcttgcgctgggagttaccccatctaaagtgccgcattggacggcattcctgtcgatgctgatagggctgttctacaataaaacatttcggcagaaactggagtatcttttggagcagatttcggaggtgtggttgttaccacattggcttgatttggcaaacgttgaagttctcgctgcagataacacgagggtaccgctgtacatgctgatggtagcggttcacaaagagctggatagcgatgatgttccagacggtagatttgatatattattatgtagggattcgagcagagaagttggagagtgaaggaaattgttgttacgaaagtcagtgattatgtattgtgtagtatagtatattgtaagaaatttttttttctagggaatatgcgttttgatgtagtagtattttactgttttgatttagtgtttgttgcacggcagtagcgagagacaagtgggaaagagtaggatgaaaagacagtctataaaaagtaaacataaaataaaggtagtaagtatagcttttagctgaaactccgggtaagagacaacagggcttggaggagacgtacatgagggctatttagggctatttagggctatgtaaaagtgttgtagggctaaagaacaggatttcattttcattttttttaatttcggtcagaaagccgggtaaggtgtgacagcgagagtaaaggtgtgtggtgtgggtgtgggtgtggtgtgtgtgtgtgtgggtgtggtgtgggtgtggtgtgtgtgggtgtggtgtgtgtgggtgtatgatgtaatactggacaatattgaagagtggcataggatgatttgccattttgatataattgttaaaaaaagccaaactaaaaattattaaagaaataatcagcatattctagaggcactcaaaataatgaagtaattttcattattttgagttttttgatatggaacttgttccatatgtctaggaacatagagtaatctgcgaaaaaaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcattattttgagttttttgatatggaacttgttccatatgtctaggaacatagagtaatctgcgaaaaaaagcaaggtagcacaagtctccaccttgcttttttcttgattactcacctgtagaaggtaaggcagggatattatttgattagtatgctgctcaaataataaagtgttcaggatgaagaaatttatgaatatacatcgtcagatatggtataatctatttactgctatataaaataagtcttaggggggcgaaataatgacagataactcaaaaaaaattataaaaatgtggaaaagaaaaaatattaggactgcttttgaattagataatgctttagaaaattttcaagttttgtttgcttataactctaatcatattgagatgcctgaagtcacttatcatgatacgcgggagatttttgaaaatggtaaggttacaaattttagaggagatattaaaaacttatttgcaattcaaaatcaaaaaacatgttacttgtatttacgtaacagaatagtaaaaaaagaaaaattaagtgttgacctcattaaagaaatacatcatgaattagtaaaaggaacatatgatgaaagaagatttgagcgaggtgaaagaccaggagaatttaaaaagcatgattatgtgactggaaaaaatgaagtgggttcatacccgaatgaagtagagggagatattagagagttagtaacagaaattaatgaaattgagataaatgaggataattgttttatggtcgcagcttattttcatgctcgatttgaaaatatccacccatttgctgatggtaatgggagggtaggaaggacattattaaactatctgaatatgattaataatattccaccagtaattgtttatgatgaggacaagaagtattattatgaatgccttgaaaaatatgatactgatgatgatattagttcacttgaggaattttttgaatatgaaatggagagaacatggcaaagagaactgcttgaaataaaaaagaatacatcacataaaaagttatcagatacaatggaaaacacagtcgatagacttaagacggaagaaaaatagttttacgctcagcagcttatacttaagctgttttcttattgattaaatgattttattgtaagcgcaaaataaaaaggtgcatttaatttatcaaacttttgtgacactatttagctaaaaattatatatgtctttttgactatctttttatatcttctcaaatgtccgaatagccccattttatcagctattcgggcattttgtattagtggtaaacctcacatatcaaggtctaacttcttatatttttcctatcaaacgtggttaaaatcgtggtaaatacttcttatgcaattagacgctgaacctctgattttgcggtatctatggacgcatgagcataccagttcatcgtgatactgatatttgaatgtcccatgatatactgtaaatcctttgggttaatattcttacatgccagccttgtgcagaacgtatggcgtagcgtatgcggtgtgatatgtggcaagggcttatccttgtggtgcttgttatatttctttaccatacggacaaataacgctgtgtaatcaatcgctacctttggttttcctttggaattgacaaacaagaaatccttgtgtccgtctatctccattgaccttatctttgggcgtttcttcattactctgtgaaatgcccgaatggtttccttgctcaagggcacgttcctaactccgcttttggtcttaggcgtttcaatgtaatagccctgttccttgcttttcaataactggtggctgactacgacaacctcattcttgaaatcaatgtctgccattgtcagcccgcataattcagaaatacgaagccccgttttcaacagtatcagtacttcatcaaaatatttatgatacacattgtctgtcttgatgaatgacagtaaggcttgttcttcttctgtcaatgcgactttctctttggtatcattttctatgacttcgctcagcttgaaatcaaagggattctttctcacataatcatcttgtatggcgatatagaatgatgcttttaacgagcgtttatggttgttaatggtattgtaggaaaaccctttctctttcatgcgtaacacccattccttagcgtcagagggcttaatggtggcaatgctcttgacagggcttttccttttctgtggtgggtaatcaagaggaagaaagaaaaagtgtgtatttttcaatgtagaaaaatatcaaagggtatgctgatttttattgtagcggatatatggaactgttataatatgaataaagcgacaaattagaatttggaggtatcctatgaaacgagaattaggaattgctagatgtggtcttgcatgttgtttgtgttcagaaaatgttgagtgcaatggttgtggctcaaacggttgtccaggtaatgatacttgtgaaaataaaaaatgttcggttgtaaaagatttgacacattgttataagtgtgaagaaaattgcaagaaaggattattgagaaaaattaaaccatacacatttactctatttgctaaaaaatatggagaagaaaagcttttggattgtttagagagaaatgagaaaaatggagttgtgtatcatcgagatggcataaacggagattatgatgattttgatgatgtagagcagttaatgaattttatcttgacaggagtgcgataggtcccagtttgacaacttcatatccatacacacaaagcagttagtcttagaattgactgctttttaaaaaggcaccatttcagtaatgatgtcttttgagtgttattttatagtcatatcaaggctcattcaatcgtggtaaattcgtggtaaaatgaatgcttttttatacttcaaaatgcttgaaagtacagtagttatacggataatcgaaaattagatataaaatttaatggagaaatataggtagaaatttatagactactatagaagtctagtaaacactataaaactttatgatatcgagtataattattagaggtgtcatgatagaagataatgtaaaaaaacaaaacatggtttaaatattttaaaaatgcaaacaattaattactgatttcaataataatgatatgatattaagtgaatggtgtgatttaaatcatgtcggtaaatccagcttagaacattttttaacatagaacaagttccatacgtctaggaacatagagtgatctgcaaaaaaaagcaaggtagtacaagtctccaccttgcttttcttcttgctcatccacctgtagaaggtgaggcagggataaatgaaatataaactgctcaaggaggaaagaaagatgggaaaactaagtattaaaaatttaaacattaatgatattgaagcattatctattgaagaagtaaaaactattactttagaaaaactatacgtaaaaggatttgatatttatttagttaatctgggtgagtattttggttactctgcattagtttttaaagataatcaccacatttatttcgcgaatttatatgaactgcactatagatacaatagtccaactcatgaacagttaaagaaaaaatatatcagtttactaaataataaattgtttacagatgaagaactaacaacggtaaaagatcacaaagactatgagaagaaaacccattttattagaaattatatgccacaagagtatgattatttaacagctttttgtatcaacggaatatataaaggtaaagaccaagaaaaatacgaaagcggggaatataccgcttatagcaatattgctttcgcttattttaaggataacagttatcagaatagggcgaaatcattaattagtaaattagaaaggtcatataaagaagccatggaaaacattgataattttaaagaagcagtaagacacgctttatataatcatgaggcatgtataacatacgaatatgaaacagctttagaatccatgggattggtttttgaaaatctaccaaaaaataaacaaatggcagttatagaagcatttaaagaagttacatcaataagatattaaatataaagatcgtctatataaaaagacgatttttatatttattttttcatttgcttataaggttcagcagcttgaaaccaagctgctctttcttttttatcttctatattactaatgtgctctctgctctaaataaatttatagcacaatttctagaggcactcaaaataatgaaaattacttcattattttgagttttttgatatggaacttgttccatatgtctaggaacatagagtaatctgcgaaaaaaagcaaggtagtacaagtctccaccctgctttttttcttgctcactcacctgtagaagatgtaggggatagctcccaaatataaaagaaatgagggtataattatgagcttattaggcagtattacaagagacttagggataacacaaagagtaaatgtaggtgaagtaagactaaatgacatgaatttctatgattatcaggagactgttatagatagtctagctagttctataatggaaaatggacaaatggaaaatgctattgcttatgaaagtgatgtagatagaaatggggaaattgacggttgtaaatacacacttttaggtggacatacacgatatttagcaatcagcaaactttatgagaatggtttaggtgatggttatatcaatatatcaattgttgaaaagcctgttaacgaatctatggaattaggattgattatgtcaaacaatgtacaaagaaaaaaatcgcaggaggtgagatattacgaaattcagcaatggagtacaatttacgatagaatggaagaaagaccggcaggaacaaagcgagattggataggttcaaagataggaatatccggaagaggcgttgataaaataattagtaaatttgaaacccagaataataatgtatcaagctctactacaagggaaccagctttgccggatattatcaaacgattgaaaacaaataaaaattcattaataaaaactcttgcaatgcttgaaaactgtggatgtgaatatatgactaatgatattaataatatcatagaattgttagaaaacttaataagaaactaaatcaaaaaggaacggcatagttctttttttggtatggaacttgttccatatgtctaggaacatagagtgatctgtgaaaaaaagcaaggtagtacaagtctccaccctgctttttttcttgatcactcacctgtagaaagtgaagggaaacaaccccttaaatataataagaaatgaggaaaaattatgactttattaagatatcatggatttgacaactggcaaaattttatgttggacgaggaaaatgaaagagataatatattatttggttttgagttggaagctgttcaggataatgattttaatggtgaaattttatcacccgaagagatggctgaaaagcttgaaaatgaatttggagacttgtttgtatatgaaagagacgggtcaattggctacggtcttgagattatttccaatccaatgacaaaaggatattatgaaaaaaatatcaataagttaaaaaaactgttaaacattttaaacgagtttcattgagaagtagaaggtttacaagttaaccctgttcaggaaaatgttgaacctaattatgcatactttccagtgttcttttaaaagcactacacacaccaaacatagcctatgatctattaagtttgagtgagctggctaatcaaaatattactgcctgctttaccagaaacactttagaaagatcggatggtacagtactagctcccatagtcaaacatggagacttttactggttatctaaaaaatacctaattccttcgcacatttcaaagctaacaataaacaacgtcaacaaaagcaaaagcgtaaataaatatccatatccgttaatacatcgaatgcttggacatgctaacttccgaagtattcagaagtctcttaagaagaatgcagttacatatttgaaggaatcggatattgaatggtctaacgctagcacatatcaatgtcctgactgtctaatcggcaaaagcacgaaacatagacatgtcaaaggatcacgactaaagtaccaagaatcatatgagccttttcagtacttgcacaccgatatatttggtcctgtacatcacttaccgaaaagtgcaccttcttactttatatcgtttacagatgagaaaaccagattccaatgggtgtacccattacacgaccgtcgtgaagaatctatcctcaatgtttttacatcgatattagcatttattaagaaccaattcaatgctcgcgttctagttatccagatggatcgtggctccgagtacactaacaaaactcttcataagttctttacgaacagaggtattactgcatgctatacaaccacggcagattctagagcacacggtgtcgctgaacgattaaatcgtactttattaaacgattgtcgcacactgcttcattgcagtggtctaccaaatcatctatggttctcagcagtcgaattttctactataatcagaaattcattagtctcaccaaaaaacgataaatctgcaagacaacatgcaggtttagctggactggacattactactatactacctttcggtcaaccggttatagttaacaaccataatcccgactcgaaaatacatcctcgtggcattccaggttacgccttacatccgtcacgaaactcttatggctatattatctatcttccatcattaaaaaagacagtagatactaccaattacgttatattacaagacaagcaatccaaattggaccaattcaattatgatacactcacctttgatgatgatctcaatcgtttaacagcccataaccaatcttttattgaacaaaatgaaacggagcagtcatatgatcaaaatacagaatctgatcatgactatcaatcggagattgaaataaactctgatcctctagtgaacgatttctcgtcccaatcattgaaccctttacaattagacaaggaaccagtccaaaaagtacgtgcaccaaaagaagttgatgccgacatatctgaatacaatattcttccatctactatacgatctcgtacaccccatatcattaataaagagagtaccgaaatgggtggtaccgttgaatcagatactacttcacctagacactcgtctaccttcactgcacgaaaccaaaaccgacctggtagtaccaatgagatgattgatttgacctcacaggatagagttaattatggacttgaaaacatcaaaactacacgtttgggtggtacggaggaaccatatattcaacgaaatagtgatacaaatatcaaatacaggactacaaacagtacgccctcaatagatgaccgttcgtccaacagtgactccactactcccatcatctccatagaaacaaaggctgcatgtgataatacaccctccattgatacggatccgccagaatatcgatcttctgaccatgcgactcctaatataatgcctgacaaatcctcaaaaaatgttacggctgattctattcttgacgacctcccacttcctgacttaacccataaatctcctacggacacttctgatgtttcaaaagatattccacacatacactctcgtcagactaattccagtttgggtggtatggatgattctaatgttctgactactaccaaaagtaagaaaagatcattagaagataatgaaactgaaattgaggtatcccgagacacatggaataataagaatatgagaagtctggaaccaccaagatcgaagaaacgcataaatttaattgcagcaataaaaggagtgaaatcgatcaaaccagttcgaacgaccttaagatatgatgaagcaattacatataataaagacaacaaagaaaaagacagatatgttgaagcttatcataaagaaattagccaactattgaaaatgaacacttgggatacaaacaaatattatgatagaaatgacatagatcctaaaaaagtaataaactcaatgtttatatttaacaagaaacgtgatggtacacacaaagctagatttgttgcaagaggcgacattcaacaccccgatacatatgattctgatatgcaatccaataccgtacatcactatgcactgatgacgtcactgtcaatcgcattagacaacgactattatatcacacagctggacatatcctctgcttacttatatgctgatatcaaagaagaattatacataagacctccaccacatttaggtttgaatgataaattactacgtttgagaaaatcactctatggtttgaaacaaagtggtgcaaactggtatgaaaccattaaatcatatttaataaattgttgcgacatgcaagaagttcgcggatggtcatgcgtatttaagaatagtcaagtaacaatttgcttattcgttgatgatatgatattattcagcaaagacttaaatgcaaataagaaaatcataacaacactcaagaaacaatacgatacaaagataataaatctgggtgaaggtgataacgaaattcagtacgacatacttggattagagatcaaatatcaaagaagcaagtacatgaaattaggtatggaaaaatccttgacagaaaaattacccaaactaaacgtacctttgaacccaaaaggaaagaaacttagagctccaggtcaaccaggtcattatatagaccaggatgaactagaaatagatgaagatgaatacaaagagaaagtacatgaaatgcaaaagttgattggtctagcttcatatgttggatataaatttagatttgacttactatactacatcaacacacttgctcaacatatactattcccctctaggcaagttttagacatgacatatgagttaatacaattcatgtgggacactagagataaacaattaatatggcacaaaaacaaacctaccaagccagataataaactagtcgcaataagcgatgcttcatatggtaaccaaccatattacaagtcacaaattggtaacattttcctactcaacggaaaagtgattggaggaaagtcgacaaaggcttcgttaacatgcacttcaactacagaagcagaaatacacgcagtcagtgaagctattccgctattgaataacctcagtcaccttgtgcaagaacttaacaagaaaccaattattaaaggcttacttactgatagtagatcaacgatcagtataattaagtctacaaatgaagagaaatttagaaacagattttttggcacaaaggcaatgagacttagagatgaagtatcaggtaataatttatacgtatactacatcgagaccaagaagaacattgctgatgtgatgacaaaacctcttccgataaaaacatttaaactattaacaaacaaatggattcattagatctattacattatgggtggtatgttggaataaaaatcaactatcatctactaactagtatttacgttactagtatattatcatatacggtgttagaagatgacgcaaatgatgagaaatagtcatctaaattagtggaagctgaagtgcaaggattgataatgtaataggatcaatgaatattaacatataaaatgatgataataatatttatagaattgtgtagaattgcagattcccttttatggattcctatatcctcgaggagaacttctagtacatctgtatacctaatattattgcctttttaaaaatggaatcccaacaattatctcaaaattcaccaaattttcatggtagcgcctatgcttcggttacttctaaggaagtcccatcaaatcaagatccgttagccgtttcagcttccaatttaccggaatttgatagagattccactaaggttaattctcaacaagagacaacacctgggacatcagctgttccagagaaccatcatcatgtctctcctcaacctgcttcagtaccacctccacagaatggacagtaccaacagcacggcatgatgaccccaaacaaagctatggcctctaactgggcacattaccaacaaccgtctatgatgacgtgttcacattatcaaacgtcacctgcgtattatcaaccggacccacactatccgttgccacagtatatcccaccactgagtacttcctcacctgatccaatcgatttaaaaaatcaacactctgaaatacctcaagctaagacaaaggtgagaaataacgtcttaccaccacacactttaacatcagaagaaaacttttctacatgggttaaattttacatcagatttttgaagaactctaatctcggtgacatcattccaaatgaccagggtgaaatcaaaagacaaatgacttatgaagaacatgcgtatatatacaataccttccaagcatttgccccatttcatttattgccaacatgggtaaaacaaattttagaaattaattattctgacatccttacagtcctttgtaaaagtgtgtccaaaatgcaaactaacaatcaagaattaaaagattggatagctcttgccaaccttgagtacaacggaagtacatctgctgatacatttgaaattacagtcagtacgatcattcaaaggctaaaagaaaacaatatcaatgttagcgacagattggcctgtcaactaatacttaaaggtctatccggtgacttcaaatacctacgtaatcaatatcgtaccaaaacgaacatgaaactttcccaattattcgctgaaattcagttaatatatgacgaaaataaaatcatgaatctaaataaaccgtcccaatacaaacaacacagcgaatacaaaaatgtttctcgcacatctccaaacacgactaacacaaaggttacaactcgtaattatcatagaacaaatagttcaaaaccaagagcagcaaaagctcacaatattgctacatctagtaaattctcaagggtgaacaatgatcacattaatgaatcaaccgtttcatcacaatacttaagcgatgacgacgaacttagtcttaggccagcaacagaaagaatctaagccaacacacacaatagacttgcaacactttttttgagattctccagctagaaccctggcaactaaagcgtatctttcttccacagtatactcagtacaggtggtaggatgttttaaagcatctattccatgtaagtcagcgattttgacccatgtagtaattccttttctaaagtttttttgtccaattccttctggtgtttcatgccatcgaccatttttatatagttcaacacacttcaacttaaatacataatcatatttcatataaaaaccctccttactggtttgcccagtaaagagggtacgcatcacaaataatggaagttcattttattatcagttagtcattttttaatatataactgtctagatcaaccaaatatataaaaatcagctatcctaaaatataaaaagaagggaaacatatttcccttctaaatcaaactattgtctttaaaatctattttcatttaataatttgtacaagctaaataatcatactatttttgaattacgatattgatatgctaataaacctgttaataatagcattccacctggtagccaaaatactacaaaatgataccactttaattttaatcccttaaacttattcagcatcttatatcccctttatcaatctacatataatataaggagataatcacatattgtcaacataattcggcataatttagatttattaagactttaatttttttaccataaataccatgtcatcattaatcttaaaaccatttttctgataaaaatcagcactgtaaaattctcgtcctgtcaacaaagttaaattatcaacttcaggtaaacattcctctaatgcctccatcattttctttcctaatccccttctttgacaatgaggatcaatataaaaatcttcaatcataaaatcaagatcattaacatatgttattaatttcccacaaacaacaccagctattttgttatctaacatatacacaaaacaccttgtatattttccgtcgtctaactgttcaattcgctggtatgatctttcataactccatacctcattccaaggaggatttttaaatgcttcaaccatcagtttagcaatctcttcatagtcatttttagtgacacttctaatcatctaaaatctctcgctttccacaaacacaataattactcttaaatcgttctacagtatgaactacttctttagttaaaaaatcaataagtctttcatccaattgatgttcttcaaaactactttggttaggataaatgagtttaccaggaaactttgtttcaaagaaaattgtatttaaaatcgtaatgctttcaagataactccctaatgaagttaaatgctgattgtcactttggaacaattctaattcgggattttgatggcttaaacaattaatgacataacccaccggtattccatcaactaaattatccatcattacttgatgataaatatctttggttgttttaaaatcatcatcataattccgttggctccaaggaatcataatgtatggcataacaccacagctacgtgccaattcaatcaatgctttagcatcatgcaatgttgcttctttacttggacaaggctcatgtgctgcctgttgaaaaataacaaaatcatatccttgttttaaagcgaactgtaattccattgactctaaatggtcgtgaaaggtaattgcaggacgggccaacattgtcacttctaacttttcactactattgattcgcaccatttctggcatatcattcatatacgtatgcgaattcccaacaaataatattttcatcctaattccacctactttcaaaggactactcctttagtatagcttcaattacgactacttagcaatctttttaaaagtaattattgctttaaatagatccccatcgattgcaatattaaaagtccccccctgtgcttcaacaaaacttttagctattgctaatcctaaaccactgccactttcatgacgcgatttatcaccacgaacaaatctttctgtaatttcttgaggactaaaattcatctgctcttgtgaaatatttttaaaaataatagtaatatcctcagtttcctccgttaaatcaacatatacacggctattaaatagagcatatttagaaatattagtgaatagattctcaaaaatacgatacgtcttatcaccatctaatttgaggattatatcattatgtggataattagtaataacagttaattgatgcgcatctaatatttcactacattcagcatgcgcctgctcaattaatgcaacaatattaagttccattaaatttaacttgatattaccactattaactttactaacttcaaataaatcttcaattaaattcgttaaacgattagaatactgatttaaattatctaaatattcatgtcttgtctctattggtaaattatcatcttgcaataaaacaatataatttttaatacatgtcaatggtgtttttaagtcatgagaaacattacttactaattcatttttcatattctgagacttagtttcttctttaacagcagtttcaaaaccaattcgaatatttttaaattcatcatttaaagcattaaaaatacctaaatcaccatctatctctacatcaaaattacctttgcttaattcttttgttgcagtcaataatttatcatagtcatcttgcaccttcagcactttatctttgacccaaaaaaatactaaaaatgcataaataatagctaggaaatatccaaaaccccaaaaagtaatcatgatcataatgattgctgtattaatcaaaatatatttcatgattgtttgatttaacgactttgatagatcaatatcggcaatttgattaagtttatttttgatactgcgtactccactaccaattaacgtatcttcttttaaataacgccagaatcctcgagcaaaaatgtactttaattggaagattcctaatgaaataactaaaagcgtcagtatccaaatcacaaaattaataactataacgatgtaatctacatacatgatgtcatatctttttaataattctaaaagtgaattattaagtgtataacccgtcacgatcatacagcccataacgccaaaagtaatcataagcgttaaaacagctagatttatttctgctttccatctctttactgacaaaaacggattaacatcttctacaattttaattggataaaataagataaataagactaatatagctgaacaacttaataacgcaatagctgaaaaataattatagttttcccatgaattaacatattgtgaagcatatccatgactggctggtgtttctggaataatatatgtaatttgaagattcttaggaacattaatcttgattgcatttgtatcaaacatccagttgtcaatatatatagtattttcaccatcataatgtgcaaatgagcttaaaaggttagcaatattaaaatatgatagtttatcactacttaaatccccattacatgaaactagaccattttgatcatagctcgcctcagtatagaaactatatttactttgatcatcattagttgtaattttttcactatgttgcgaaatcatttgattagtattagtattaacagctttataaataaaatctccatcattattaaacaatgatgttattccctttaaataatcgtcaaaaacatctaaaaatatttgtcttgtctgttcatcaacactatcatcaaagcttactgcttcaaaattagaatcaagggtcttagccatcgcaatagtaaaaagctgtagatcatcttctaaaattcccgttaaattatcatcacgaggggtattttctctaacattatcatataaggatataacaacaacggacattaatagtaatattgatgcaaaaatcacaccaaaaattcttttagcttttgtcattttttacactcctttttcaattttatatcctattccccaaactacttttaaatattctggttttttaggattagcttctattttctcacgcaattttcgcacatgcaccataattgtctcagtatttatggcttcttctttccaaacagcttcataaatctcctcagctgaatagactcttcccggataagacattaataattcaagtatttgaaattctttagccgttaaacgaacacctcgatcattaacaaacacttctttagtaaacttatccagctctaatccacccacgactaagcgctgttgattattattaagattacgattttcttttaaagctaaaatttgattatatcttcgaagattcgaattaactcgagctatcaattccatcgcctcaaacggcttagtaatataatcatcaccaccaatattaagcccggttattttatcaatatcttcagactttgcacttaagaaaataactggaaaatcatagttttctcgtagttttagtaccattgtaattccatccataactggcatcataatatcaaccactgctaaatgtatttcatttgcttcgattaatgctaacccttcttcaccattactagcttgtaaaacattatatccttgattcttcaaaaaaactgttactgtttctctgattcctttttcatcttcaacaattaaaattgtatgttccataatcttctccctttttctaattagaattaactatttttttataataaacggcaccggtaattactagtataacagttaccgcaaagattgaaacagccaatacaatattgccgtctcttaatgctcccgttaaatatgtagatgtcacaatacttggaattcttccaatcgttgtaagcaatagccattgttttatatcaatatctgttaagctaactaaataagtcataatatctttaggacttccaggaatcaaaaaaataataaatagccaaaacttactttttttagaagaaaataattttttcacttctgcaactttactttgatcaaacattttatcaatgattgagtgttgaaagattcgtgctaaatagtaaacaataatcgttccaatcattgacccgatcaaacaaacgattgttccttgaaatgaaccaaaaatatatccactagccagctccaaaggttctccaggtaaaaatgctaaaaagatctgcagagcaattaaagcaatcattgctgaaactttagtaaaatatggcagtgtttcaatctcataaataacatcattaaaatcgcagtttctaaataaatatattgtaataaatgccatgaacaaaataattgatgacatcatgagcaaatttgtcttttttattgatttaagcataagtcgttccgcctttctatacttaaataataaaagactatcctaaaactaaactaacaataattcttaaaaaattctaaataaaaaccacgcctaaaagacgtggttttctctgaggctataagcctatgttgcttgctcgcgtctcaaggcgctaaaaaaggatacgcagaggtatccgtaaataaaaaaagaaccggcagcttgctattgtcgcaccttggtactatcttcgccgttatgatgcttaacttctgtgttcggtatgggaacaggtgtgtccatcatgctatcgctaccagatcttcttttctaagcaattcctttcgagaatcactcaaaactagataatagttttcttgcgtcttttgtcttccactttgtcttctttcagtttcaagccttaaccctttttctctaggttaagtcctcgacctattagtatcagtccgctgaacatgtcgccatgcttacactcctgacctatcaaccttatcgtctttaaggggtcttacttacttgcgtaatgggaagtctcatcttgaagtgggtttcacacttagatgccttcagcgtttatcccttccatatttagctacccagctgtgccactggcgtgacaactggtgcaccattgatatgtccatcccggtcctctcgtactgaggacagatcttctcaaacttcctacgcccacgacagatagggaccgaactgtctcacgacgttctgaacccagctcgcgtaccgctttaatgggcgaacagcccaacccttggaaccgacttcagctccaggatgcgatgagccgacatcgaggtgccaaacctccccgtcgatgtgaactcttgggggagatcagcctgttatccccagggtagcttttatccgttgagcgacggcctttccattcagcaccgccggatcactaagcccgactttcgtccctgctcgacttgtaggtctcgcagtcaaacacccttatgcctttgcactctgcgcttgatttccatccaagctgagggtatctttgggcgcctccgttactctttgggaggcgaccgccccagtcaaactgcccacctgacactgtcccgttgccagttccatggcatccggttagaactccaatacaagaagagtagtatcccaacattgactcctcacacactggcgtgcatgtctctcagtctcctacctatcctgtacatcttgcatcaaagtccaatatcaagctacagtaaagctccatggggtctttccgtctagtcgcgggtaacctgcatcttcacaggtactaagacttcaccgagtctacagctgagacagcgcccaaatcgttacgcctttcgtgcgggtcagaacttacctgacaaggaatttcgctaccttaggaccgttatagttacggccgccgtttactggggcttcaattcaatgcttcgcttgcgctgacacatcctcttaaccttccagcaccgggcaggcgtcaccccatatacgtcgtctttcgacttagcatagagctgtgtttttggtaaacagtcgcttgggccgtttcactgcggctcatatctctatgagcactccttatccctaagttacggagtcattttgcagagttccttagctatagttctctcgctcaccttaggattctctcctcacccatgtgtgtccattttcggtacgggttactgtatgattatcactagaagcttttcttggaagctggcttcacggacttctgtacttgccgcagctttccatacgcctcacgcctttgcctttcgacagccggatttgcctggctgtcggctgcctcgcttgcacctgcatttccatcagcaggatccgctagccttctccgtcactccatcattcataccgtaagtacaggaatctctacctgttgtccatcgactacgcctctcggcctcgccttaggtcccgacttacccagagcggacgaaccttcctctggaaaccttgggttttcggtgcgtgggattctcacccacgtttcgctactcacaccggcattctctcttctatgcgctccacggctccttacggtaccgcttctccgcacatagaacgctcccctaccactcacgcttacgcgtaaatccatagcttcggtaatatacttagccccggtaaattatcggcgcagagtcattcgactagtgagctgttacgcactctttaaaggatggctgcttctgagccaacctcctagttgtctggacatctccacatccttttccacttagtatatattttgggaccttagctgatggtctgggctgtttcccttttgacaatggaccttatcacccactgtctgactgccgagtatatctttgtgacattcggagtttgattatgttcagtaccccgagatggggccatcacatattcagtgctctaccttcacacgactttacctcgacgctagccctaaagctatttcggggagaaccagctatctccgagttcgattggaatttcacccctagccacaactcatccgccaacgtttcaacgggggtcggttcggtcctccatcgggttttaccccaacttcaacctggtcatggctagatcactcggtttcgggtctacgacatgcaactttcgccctgttaagactcgctttcgcttcggctccgcatatcctgcttaacctcgctccatatcgtaactcgccggttcattctacaaaaggcacgctatcaccctttaacgggctctaacttcttgtaagcatatggtttcaggttctatttcactcccctcccggggttcttttcacctttccctcacggtactggttcactatcggtcacagaggagtatttagccttaccagatggtcctggtggattccgacaggattcctcgtgtcccgccgtactcaggtgctgtctcgtgcttcttcactatttcggctacggggctgtcaccctgtttcgccggacttcccattccgttcgcctataatgatttcttgctctttgccgacagtcctacaaccccgatcctaagatcggtttgggctcttcccctttcgctcgccgctacttagggaatcattcgtttattttctcttccttcaggtacttagatgtttcagttccctgagtctcgcctctctgaagctatttattcacttcaggatacctggtctctactccaggtgggttcccccattcggacatcgacggatcgttgcatgcttactgctaaccgtcgcatttcgctgtttgctgcgtccttcttcgcctctctgtgcctaggcatccgccatacgctctttcttactttacctattttggtgtttgcttgattactattttcaactatttactaaaatccatccatccgtttcgatttatgttttttagtgatgaaaattcttagttttcgacttttctagaaagacctcaataataacaattactatttcgatctcattttctatttctatcgcaatttattttctattatccagttttcaatgatctctgagtcatacctgagtatcactcaaaactaaacagtatcttcgaaacatcacttctcttgtgcatcatcttcgatcatgcgtttctccttagaaaggaggtgatccatccccacgttcccgtagggataccttgttacgacttcaccccaatcatcaatcccaccttagacagctccttccttgcggttaggccaccggcttcgggtgttatcaactctcgtggtgtgacgggcggtgtgtacaaggcccgagaacgtattcaccgcgacatgctgattcgcgattactagcgattccaacttcatgtagtcgagttgcagactacaatccgaactgagaatggttttatgggttttgcttcacctcgcggcttcgcttccctctgcaccatccattgtagcacgtgtgtagcccaggtcataaggggcatgatgatttgacgtcatccccgccttcctccagcttgtcactggcagtctcgctagagtccccaacttaatgatggtaactaacgataagggttgcgctcgttgcgggacttaacccaacatctcacgacacgagctgacgacaaccatgcaccacctgtatctcatatagctatctctccatctctggagcctttatgagtatgtcaagacctggtaaggttcttcgcgttgcttcgaattaaaccacatgctccaccgcttgtgcgggcccccgtcaattcctttgagtttcattcttgcgaacgtactactcaggcggagtacttattgcgttaactgcagcactgaactttgacatccaacacttagtactcatcgtttacggcgtggactactagggtatctaatcctatttgctccccacgctttcgggactgagcgtcagttgcaggccagatcgtcgccttcgccactggtgttcctccatatatctacgcatttcaccgctacacatggaattccacgatcctctcctgcactctagctgcctggtttctatggcttactgaagttaagcttcaggctttcaccacagacccttgctgccgcctgctccctctttacgcccaataattccggataacgcttgccacctacgtattaccgcggctgctggcacgtagttagccgtggctttctaataaagtaccgtcactcggctaccatttcctgtagccgccgttcttcctttataacagaagtttacaatccgaaaaccttcttccttcacgcggcgttgctcggtcagggtttcccccattgccgaaaattccctactgctgcctcccgtaggagtctgggccgtgtctcagtcccagtgtggccggtcaccctctcaggtcggctacgcatcgtcgccttggtgggccgttaccccgccaaccagctaatgcgccataagtccatcctctaccagtgctttgaggcacttttaatacggtcaccatgcagtgtccgtacctatgcggtcttagctatcgtttccaatagttatccccctgtctagggcaggttacttatgtattactcacccgttcgccactcgagcacaagtgctcgcgttcgacttgcatgtattaggcacgccgccagcgttcatcctgagccaggatcaaactctccattgtttatttaaacaactcttcgtttgtttagctcttttttcttttttatccttctggatattgacgtgtgtttcttaattctgtttagttttcaatgatctctgattcattgttttttgaataatgtcaccattattatcttcatttaattcaagttctgtaattttatgtttaatcatgagcttatttgctctataagtagccagttgaatttcctgatcactggccccaggatcctcagcgattgccatcagctttttaatcttatcaattattttttccatttttaatcacctgatttctgtttacgtgttcatttgccaactcctttataatatcttctatttctgaagtatgtactatatttaatctgtctacttctattgcatgtttaataattcttttagcatgttctctagaataaccctttaaaacagttttcataacaatatttccttgattgtcacgtctttttacctgaatatcatattccatactctcacctcttttattttgaaaccgttttgtttatgactattttcaattgtgaatagtctttgattattaaattgttctttcgatcataatagataatgcagtcatgaaaatgattaaagtcatctttcgggtaacaaaacagataaaatctgcttataacggttttttttcttctgattgtgttttctgttcgattttttatatcttttaggtatgtttcataatctttgaatacattttgtgtttcaattgtcttattatgttcacaaagaaacattataaattccgcaatatcatctttatatgttttttttgttttatacagcccatccatttgatcaacatattcattaattttttgtgacagatccatagtttcaccccattcctgctggattttaaagtaatgtgtaatcatagatatatttttgtttaaactcttcaatataagttctaataatcaaatcttcaagctgatcatgtgattctctaaaattgacaaatgactgcttatacccaagatatatttctggactgcaattgtcttttttaaaagttgatgcatatattattttatttaatttaaacagcaggttattaaatatctttacagtaataccatctctcaattttttataatcttcaaatccaccgtcataaattgcattttgtataaaattcagttcattatttattcgtatcagcattttattttttataagtttcttttgaatcattaaaatattgtcggttgattctattttaaccaacgaaaattttctgtataatctataatttctagtaaacagcatcgcaacataacgaacttctttttttataccagcaataaattttacaaaagatctatatttaaatatctttgcttcctttttttgaacatagattttctcatactgcttatttccatttctatctaattttgcttcaccttttttatgttttaaaactgcattaggatgatcttcagtacagcgttttttgctgttaaaatcctgataatatgtatcgttatatctaatcagcttcttatcacctttgcaaaaagttacacgtgtaaacatcagaaattctaaatattctccatttcctttttctaaaaatttataacagtaggggatggttttatatcttggatcaaagttgactgcaaatttttttgcaaattcatgtttttcatttaaacttaattttttgggtatcataatgtttataacatgagcaaatatatttttataagtacgtttgttttcagtatttttatacttatacaagtgactttctttgtgttcaactaatcgtacaatatgtttttgataatcagtcttattggaatatatttcttgaattccgctatctctgagccattcccatacttctgttttactgtttaatgttctatattctgcaaaatcattataattaatcattgttactttcctttatatctattaaattgacatctaagcttcgcttagatgtttttttagatttctcaaataaaaaatctaaaaaaatatgactttaagctaatttttaagcttttaaaattttgtatttgtttattagaaaatgactatatctttcctgaagaataccatctacaattattctgctggaacggtactcaccagtaacaataacaagatcaccatcttttgcttctttataaaatcgttcagccttttttccgtaaagggaacagtctaaaagatcatatatatcattttcatcacgttttatttttaaaataaaatctaaaaatggtgtattagatttttcttttattccatatttcatatcaaaaataatgccacacagttgatttgtattaaacataatctatccaaaggagcgattataaatcactcctgattcctttcttttgtaataatttaacaatctctatgcatttatctgccatactgtctatatctttgtatttgctttcgtttcgtaaataacagtctgttattatctcatttattacgtacgtataagtagcacagcttattttcatcaacataactactgcggtttcaatgtcaacatatgatgcaatattaattgttctataataactttcattgcttacttgccacgaaagtttaattcgtcctaatttataaaagcactcaattatcagcttagaaccactgtacatattaaattctgttttcaatggggcattccctttacagtgagtaatagctaaaagattatccttcaataaaatgatatgattatcattaatctctttaatttcaatttttttatttgttctattatttttttctatctcattgattgttttctttataaagttagcaggtatttcctctcctataacagctttcttttccatagcttctactacttcgtctttatagtcactggtagctatcatataagctccctgaagatttatttttttgttaagaaacatttctgtaacacgattatcatttttgataatcgacattaactgttgtacagctgttgctgacatacctaaatcgttcgctattaactgttttgtaggaattcctttattttcaggaagatctcttattacaggaattaccttttcaagataaagttttacttcacgacatttatcctgaacagtacgttctttttgtgttgcattatcacgcattaaagaacgtaatgagctggcttcatcatcaaaattcgttatataacactctatttcttcatatcctgctatttgttcctgattaatcaactgataagcataatatctgctatgccctttattgattacatatccatcttgagtatcctcaactacaatagggttatttaatccctcgtctaaaatactggctttgattgcaattattttttctaaatgctcatctttaatgtaaggattatttttgtttggtttaatcatatccaaaggaagtttaataacttctcttggatcgatactgttcattatgtcaaacgccattattcatcacccccaaacagttctttagcaagtgataaatattcatcagctaatttagatcttctactacctttaaacatggaaaaatgcttatcatgtacatttgagtttgaattgtctactacagcagtttgatttcttagcacaacagaaaatctatgatttccagacagattattaaacactttggctaatttattcccatctaatctgttcaattcatttataaattctttatgtagtttaatatttcgattagccatagtaataagaattctaaaatttattttaggattatccatcatagatgcctgattaataaaatctatcgtttgcatagttcctgatacactttgaaattcaggctgtaggggaattatgcattcgtcagaagcatttaatacgttgctaaggatattatccgtagcaggggcgcagtcaaatatgattaagtcatatttatctctcaccggttcaactacaagtcttaataaataattggctgatgaagaaataaatcttttcgctgtatttaactgaacgtcagcggtaataatatcaagattttcataatctgttttttgtacagcatcttcaactttagcctttctcattaaaatatgagaaatattaatagtttgattatcaatttcatttggatcataattgatcatgtaatcaactagtcctttaccatcaaaaatattattttgattaataaacatttttgatgtatttccttgttgatctaagtcaacaagaagtgtttttaatccaaaattttgtgttgcaataatacctaatgtttcggctgtggtagatttacctacaccgcctttttgattcgtgattgctaatactttagctttctttgtttgattcattttatttcctccattttcgaccaaacctatgatttggtatattttgaggaactatatattatataaacgaaaaaacgagagtttctatagagaaactctcgttacacgtactctttaatttttatgtaatcaatcaaaaagttcgactaaatacattatggagcgggtgatgggaatcgaacccacgtagtcagcttggaaggctgaagttctaccattgaactacacccgcaaaaatggtgcccagggccggaatcgaaccggcacggattttaaggtccgcaggattttaagtcctgtgcgtctaccagtttcgccacctgggcgtggctataaaaatttaaatggtgacccgcaggcgattcgaacgcctgaccctctgattaaaagtcagatgctctaccagctgagctagctaatgataatgtagatcgatttatgcctgttaactcttctacttcgaactgtgttaactttctttttatcctcaactgctttaagcgttctcctatttccataatgaatgttcctcccgtgcaaatcatataaaatctattgctactttaggtagcattgctacaaagagaaacaaaaaaagaagtatcaaaataccttctatttaatacttcttctactttttaccttttatatagattgattaaaaaactggtaaatattaacaccatgcttattaccgaacaacaagctactatccatagctttacaatttacctgactctctttatgtcgtagactagataatatgctaataatattatctagtctttatctgttagagttggatagggataagataagtatacttgtttttttactcttaacagataaaatgaaaattaagaacaatgaggaataaatcctcattgttcttaatagtctaaacccgccgagaattattatatatgggagatatctctactgtttatttattaggcgagcaaaatataaaatttaaatataaaattattcttcatacgtcagcaaatatagtatctaataactaattaccaaactaacctgaataacctgtgataaataacgatagcaagcataaaacaaatataagcagtttttttactttatataccaattcctgctctcctttttttttgatatttctttaacttgctatagacatctaaatttctttttaatttagaacttataattttatcacttgcatatttatttatgtatctattaatattttcttcatgataatcgatattaaatctatctgcgtaataattttcaagataatctgtatccatctcatcataactaaactcagaatcaaaaccatgttctttgtcccactgttcacattgaaatatcatatatgctatctcgtgtggtgctaaataatttgttgatgcataatctatcgggttgttaagtagttcatttaaattgttatctatttgattctcaagtatatattcgatataccaatattcaagttcgtcctgcttatcatgcagcttctttattaccttatctgcatcaacacctttaaaacagtcatgcagatataccatttccatataattcatcatttcaataaataaattcggataactcgattcgcttataacgagttcaaattctctgctacctaagcctggcattttatcgtcctgtttaattttaattcttatagtactttcattgtcagtatcttttgctccttttaatattttgatatattcattattagcaccagttaatgtcataaatttttttccatttaaataaatgattggataattcttcacataatcatctccttacgatcctggtaaaattaccaggatttatctttttcgaccttgtataacacacttttgtctttcaataatttcacttaattcacctttattttcaatataatcagtaatcttctttgcatcatttatagcacttaacaaaacatttggtttttctttaaaccctgatatccagctttggatatatgccttgtgattatcaattcttgtattgctgatatctaaccctagatcaccgcacaaaaaagaagagcctatttctgctctaagctcttcaagtgcatattcatcgtgttcattaagcatatttctattcaatctattagggtgaccagtagaatgacaacattcatgcagtatagttgcaagatattcataactatcgtcaaaataatacctgtctggaacataaacagtatcgtaggtcttattataaaaagcttttccattgctctgcctaccttctataattgcaagatcagtagcatcacaatagtttttaatcatttcaaatcctacctcatcaatatcaaattcatttctaataatttcatatttttctatgcctttaacaagcgatgcattaaataccgtaaacgttttgcagctccaacaaaatcttgcatcaacttctcttccttcaagctgttcctctgcaataattttcttcatatccgaaacatttatatatttcttttcttctctatcgtatatgccccatttttctaacggtacaccctgtcctttagcattttctaaagtccaaccttctttcctgatttgattgaaagtaagccatcttggatcttcatatcttctctcatcatatatataatttaacaacagttgattaataccacgataaaaagtgtttgttatgggattatgctgagaatcgccgttattccatccttttttccaaggaatctgttcctgttcaagggattctatgtagccctctatcaacatttgtctggttttagacatttcattattcattagtaacacctgccccttttagtggaaaaaattgttcactttcaatatcctcatcactaatttcaatatcatcctcaatcatctctaactcttcaaataatttagaatctttttcgcacataaaaatatctcctttcaaatttatgcaataaaaaaagttatgcataattaaacacataacttttacagcaatatttcctaagctgtatacaaatatttattttttaggggctggtaaatttaccaagattcctatgagtaacagaatttaaattcttattacacttaccccaagtatgacataattataacacttttagtacaaatttcaacactgttttagtacaactttttaggtcaaacaactattttaatgttggatattcctaaatttggcttaaatacgtgattttttttgttaaaatcataacaaaaaaattcatatatttaggaaattagtaaccgaagagtgaaaaacgataaaaatcgtgtataactctacacaaaaaagcctttttttcgccgttttttgtgcaaatttatacacagtaaaacttgacaggattttagattttataaaaactgcctattttaaaagaatcagaaagacaaaacagtaaaaaatgtagagaataatatattcttatttatagctttcaatcagaaaatgaaaaaggctttctgaagctgaaccccattactgaaaattcaattcattttcgcctctttttttgtattagtaaattaaatatttaaatatttcttatcaccccaattgcttctcttcactttttactcttaaaggggctagtactattagtataatcaccattagaataatttttaattatttctgattactatctcttctatgtttatctctaatgcatctgcaatagctattacagtagatattgttggctcttttatttcaccacttaatattttttttagataagtttttccatgcaataagtctgtcatattcatccccaaattcttgccattccccattttcaaatcttaattttaaaatatcgcttgaattatccatacaattcataacatatacataatatgtaccatttgcattcggattgctttctaaaatactagtccaattatccactctttttatcctcattctcggttttaataacctttgtaaaaaaaacaaatttttttgtttttctccaatctatgcatggaacatgttccatgtctatttatcatttttataaccacataattcagcaaattcgtgatcatttaaattcaatgcttctgctatttttattaaagtatcaatgcgtggatttttaacttttttatttaaaacatctgttaacccacctgaactaatacctgtaattttacatagtttatatcggcttatactttttttaatcattaattcatcaaaatatttcttgttcatttatatcattcctttcttagttttgcataactcgaaacaatgagctaaaatataaatagcttaatagaaatgaggcaatacttatggataaaaaattattatttaactatttagatgacacttataataaaaacaaacatttttatacctataaatattttaaaacaataaagaaaatttttgacaatattgaagttaatgaacaattaacacatcaagccttatttgatgcactaaaaccatatacacaggattatgatttaggagattttggtttataccatattgattttaatattcctcatcttttggactgtatagataatgatcaaattcaacttaaactatataaaagtagtgaagttaattttgatataatatatcatgaatttccttttgattttaatccaaaaataaattataattcaaaaattattgttactgatttcaatactacagactgtaattttaccattatcgatggtaatcatactcttgagaaatatttacatgaaaacaaagcattcaatatttactatttacctttttatcaaatacctagatcttgctattgtaatgatttcagctatttatttcattatataattaatgaattttattttattttttataaagagcaaaacggtaaaagacagaaacaactaattaagaattcaaagatattctttatgctgaaagaattactttgattttacagtttttccaatcacaataaaatgacttttttcatttttcagtttctctaattctctcttttctttatgacttagcacatctgaatacatattatacaaatcaaatccaaaatgctttttgcctgctgtttagccaattcactcctgtactgatctatatagctattaatatcctctaacaattctttttcctttatcatttaaattcatccccatctctaagcaccaaatcccccatattacccctcctttgccaacgctggtaaatttaccagcgttgtaattgctttatactcatatttcatctatgctcatctgaccatttaaaacatttttatctttattttgttcatcaatctcaattgatatttgaatacatctactaaatttactgatcacattatgaatatttattaaggaatcctcgacagtaatatccctgtcatcagactctgcaatctttttatgggatatagaagtattctcaacttttttattaatcttatcaatctgctttaacagcttattgtaatctgaaaagagttcacttaatccataccctttatttttacagctatcttttttatcttcttcatgcattcctatatcgatacattcttctttcttttcaattgcatttatatatttttgtaccgttttaccggattttgcaccaataaaaggtgcaatccagtctcttttattacctttaggtttaggatccaattgtttatatatatctaacagttcagcaacaatttttattttatctagttccgacattattcttgttccattccctaaaatcaaacgcaaacgatcatttaattcgctttccggtgcttcataaatgatacagtatacttccggttctatctttccctcatcaactaactccttaagtgctgtatacctacgttcaccatcacttatcctgtatctgtcacctattttataaacatccaacggtttccttaatccatattccagaattgatgatttaagctcatcaattccattaatatcaaactgattatgctgattcacttctatatcatcaatatcaatagtttttagtcctacaggtttcttattcatcttgctaactttatcggcattgattaaatttgtaagtgccatacctttattcctcctcataatcctggtaaatttaccaggatttaaatttcattatcaaactctttaattaattcatctacaagattacgataatcctcaccaacaccagttttactgttatacagtaatttaccgctcatagtcgatcttgacgcaactgcatcctgatagcctaccgttgtctgtaaaatagtatcgccatagaattctctgattttattgataaaactgatgtaagcgggtctaacaccacgaggaatcatattcatcaatattcttattttatattcacattcataatcgtcttcaatatcaaacagttcctcaagtgtatcaatcagcccctttaattcaaatccacctggtttaagaggaattataatttcattcgaacagaatagaccatttacagtaatattattaaatgttggtgcatgatctataatcacgatatcataatcatttctaatttctcttaaagccctttttaaaatcacatgccgttgacctgtcgatgcgccaagcaacttgtctgtagcaataagttcagtaccgattgaaggaataatatccaactgctgatactgtgtttgatgaatacactctctaataacccctttgccctcaagcagtagtttatttaaatcatttctttcgccaagcatactaattaatgaattttttataaacttagttgaacttctaatatcgcagttttgcggtacctccagcatattaaactcttctagtgtaattgatttaaactccggcagaaaaaatttagtagcattgccctgcgcatctgcatcgattaacaaaattctttttccgtcattcattaatctttccactaacccgtaacttatatttactgatgcggtagtttttccaaccccgcccttttcattgataatacttataactttcatctctctattctccttttttcttttattaaatttcgattttttcatattaattccaacagtaaaaacattcagaaattaataaggttaactcattttacagaatggaatttgaatatttgatgttaaacatctacgctgcatctttcaccccaaacaccgctttgacattcttaacagtttcttcagttagttcagtatctttgaatatcttcatgcgtcttgaccagtttaaaaaatcttcataatcttttaaacgtatagtcccgtgcgttccattcttagctacatagtttactgggattcgctctttacattcactttcttttacagtttttgtattctcgccccttatattttcgtcttcatagaccagtacatcatcaatcagataaataagctctgctagtgcattatcacgaagcttatatacctgccagataggttcatactcaacatcatctactggatcgtagtaaccataacgtatttcattaaatgtagcgttataaaaataacgtagaataattacatttttttgttcttcatttttcagcatatttacagcctcaagaattctgcatatataatcttcattactatttgatctgcatacactttttataaacttataatccccgctttctaaaccgccgtcagccatccttattacagaggcagaaaatgatgaaatatttgtacagactgaataggcatgatcgagcatcagatcacttactctgtttaaaacagccttaacattttcaatagataattttatatttacttttcttttgcagttattagatttgtcattatcattcagcatcgatcattacccctctccagtaaactctaagcattgtgtcagttattctaacaatataatatgatttttgtatgttaatgctcttataatctaatttttaccaattgagacatttcaccttttctgttttttaatattctgtacagtatatttatctattccgttatagaaacatcctattttaaggcttgaaatttttcttgtttagaatatggaattcatcaaattcttcctgcgttgcttttctggatatcttatatgctcgctgtaaatttgttcttggaataaacaggttcatattagccttttcaaactttatatcaatcttctgttccagatctttaaaacctgaaagatatgtttttaccacatccgataatccttcactgtttcttatttttgtatacttgtctgctccctcaaaattgtaaaaaatcgtaacttcatcttagcacagcagtataattagctttttcattcccagcactacaatatccttcaaatcaataggtggaatcttatatcatcgaggcatattatcatatgaagtcacataatagaaattatctatttttttgactttaaatgttcctcccatattattaggctttccaataatactttgcgttatcatgtaataattgcattcatcattcttttcaatttcttcactatgaacttcttctattttcataaagaataccttatatgttgaatttatattataaacatattctgctattgctttttgtggtgttgaattatcaaatagattgcttatataattagtgtacaatttcagcccgacaaaaaatataattataacaatcaaaatattaaatactttacttctcaacaatttctttattttttctttcattagaatctaatccttacgtatgttccagaggtattttcccatccatttactgaagaacttactttagcacaatagttacttgtatgttgtgctattgttacatcataatatccactagatgttttactcccagatgcaactacaaaagcaacatgattatatcgtccatccttctcccaatctgctattataaaatcacccgcctgcaaattacctgagaatgtattaaagtttcctgatgcatattgactattacttctagaataccagtatgtttcaaaattatgcgcagctgaccaagaggctgtatatggtttccatgtagtatttgttggtgcaccacctgaccttagaatctgcgatgcaaaattagtacaatcggtactatatgttgtatagcttggattaggattaacagcatatttttttgcgtaacttactgctgtgcttttattaaagttaaatgaagcagctcgtgtcataggcaactgattaatagtatcaattataggacttgtgtacggtaagtaattgattaattcaaaaatatcgacattttcctgattacataaaatcctagcttgactatttatttcatgattttcacatactgtgaaaaattgatttaagatatttatatcttctatatctccactagcaatattatcaaaatacatttctttaaatacattaaaatattctttccaattgtttaagcttaatgtgtctaaatttccaactgatgagatttcatttaattcatcatcaaatttgctaataataatatcaaatgcagtactcatattatcaaattcccaaaacaacggattgctagttccattaacatttaatactcctcctgattttaaatcaacaatattttctaataaattgtaaggagattcactataaatattacaatctgcatctaggcttatttctttttccattgcagttacagtagaaatattagttggaaatattcccactaaaaatacagcaataattaaagatacaataaattttctactcttttttataacatatcttcctttcatatttgttgaaaacgtttccttaactatatgatagcactttatttacatatgtcaatagctacatatattttatatgtattgaattatcgattatattgtgatttaattatattagaaataggagatggattaatgagcagatcttcaaacaatttttttaggatggaaatgttgctgttaaaaatcatagaaatcggaaatggcgaatattatggttataaaatagtccagcagcttcaggagttatctgatgataaaataaagttagctgaaggagtcatgtaccccatcctctatcggcttttagacaaaggttatattatcgatgaaaaaaggcttgttggtaaaagaaaaacaagagtttattataagcttgaaccaaaaggaaaagaatatcttaaccaactttacattgattacatggatataaacactagtattattaaaatcatggaggcaggaaatgaataatgttgtcaaacaatatctaaaggaatgtagacgtacatttccatttataagtaaaaatgaaaaattattttttaagcgcttagaagataatttgaatgatattgacgaaaacgttacttataaagaaatatgcttaaaatatggtgaaccaaaaaatgttatgatttcttatatagaaaattgtgacaatgaatatatcttaaagcgaacttctattaagtccattgtgaagaaaatattcattaccctattttgtattctaatagcactatgtgctacacttcttatttataatcaattgatatacaatgcatatgatgattctaatactataaaaaaagtaactattattgaggaggagtaaagaaaatgaaaaaaatatttgcaagttttttaactgttttaacactattaggcactacacctgtatttgcattaaatgaagaaagcaatacacagatagtcgaaagatttgaggacggtagttatatcgaagtgacaatcgaagaaataccaacgcttacaagaagtaacactaaaaagggtaataaaacaacatactacaaaaacacatatgatgtaatcttatgatctgtcaaaaccagtggaacatttacttataatggctcaaccgcaaaatgtactgctgcatcagttgacactcaatgtccagctataaattggaaattgagtaatattagatcatcaaaatctggtgcaagcgcttatggatacgcaaccgcaaaaagttataacggtcttggaatggttttacaaactataaacgaaacagtaaaacttacttgcagtccaagtggaacattatcttaaaacaattaaaaataggtataacatcgaaaattaatctttttgaatgttatacctatttttttgcactattcagttaattcagtttcaattatcccgtgccagcaggtgtgatttttcggagcggttctttcgggtttgacaactccaagcatctgataatcatatttgcttgtatccttgaccgctccacccctttgctgaaaggtcagagccgcgcggttttcccaagcagccgagtgtccgctgcaagtccaagggccagaaccctgaactctggccggctggcccagccctgcttctggcactttggaggccagcgggcccttgaccacctgctgggatgggaaagggaagggtccacgaattgcaccctagaaacttagtagggtgcatgggtttcaaaacccggtggccgcccaggcagcaaacaagggaggagggcaccctgctgccctttcatggcagcatctgtggctgtcctgctgagggggcctttccatggggaccgtgtgcagtacaagtttggtgttttggaaccgaataattagaacgtgtaaaaattttaaatgatgtggtggtttgattcaaacaaaacaaaaccaaacaaaacaaaaaaccaagctccaagttttttgcaaatttaggtcttaatattgaaggcctgtgttccttccactgtggcattgtacgaagaaatgtgcgggtttttttttttttttttttttttttttttttttttttttttttttttttttaatttgttttttgtttttctttttttttagaaaagattccgaaaaatgagggaaacaggaagcccagaggtgcccctgtagtttggcgaaggccttaggaggtcacttggaaatgctgctggctgtgagggggggagggggcagatgtgcacagagctgtgcaggcttgtcctttgcatggatgttctttgtagaaatccacctcggaaccatctcctgatgtgtaagaatttcccagacaaaccttgagctaagcaatgcgttttttccttaggaaatgttggtcttcagcgatgttcaaagcctgtgtatttcggctagactctggcttcaggtcggttcccccaaaaggctccgaagcgacctgaaccaaacagtaagttttcctcctaccttgttctcctcatctatgttaagagtatactttaagagtatcctggcacatacatgtactgcctcacccctaacctcagtcatgtgttccaagaacttctgtccgtttatttatttgttttgggtaacattgaattcgttttgactatgctgggtctttgctgctcgctggaagttgctaggacctctggactgcagtctcccatctcttgctgacctcttgttgacctctgcagaatcctggttggtgggagcttgttagttccttgttccttacccggacctcctgtggtaagtgttttctctcctctggggcctgctaagggtgggtgggcattggcatcccaaaggtggctagaagtcaatgatttaggcaggcttgtgaatagatatgggagaaggcaatggcaccccactccagtactcttgcctggaaaatctcatggacggaagagcctggtaggctgcagtccatggggtcgctcagagtcgggcacgactgagcgacttcactttcacatttcactttcatgcattggaggaggacatggcaacccactccagtgttcttgcctggagaaccccagggactgcggggcctggtgggctgccgtccatggggtcacacagactcggacacgactgaaacgacttcgcagcagcagcagcagcagcagcagcagcagcagtgcatagatatcaaaagggtttagaacagtcaggtaggatcacacaagtcaccgtgaagcaatacttctccacttagccaaagctaacaaaagatttctcttctaggtcaacctagaagagatcacggaagaggtaaagaaacttaaaatccattagcaaaggcagttcaacctctcaagaaaccttgtgctaggcacaacactcttttctgggggtccacgttccctacaacctcctgatcccattctgtacccattcctttgcttctcccatcctgaaactgccacctggaagaaagaacgacgtcgttttccttcagaaaatgcgatttcatgccacataccttcttttaataccaagtcatacagttcccttcagcaaccaagaactgacttttatattggcattcgacagattggtgaacatacctatcagtgatagtagcgcccctcccctcccccgcacgcacgcacgcacgcgcacacacacacacacacacccccaagatcagaaccaaacaaaacaaaaaaaattgctttcttacgtttcacatgtcaggatggtgccagacactcttattggatagtcaaaaatctcttttgtttctgtgtaaaagggaggtcctttcaaggcgtgaatgtttcagaacttgaatttatttggaaatgacccagctcttcagtacactgtcgtcacttagtttagcacaggatagaaactcgggtaaccaaaacacctggagaaacgattgtatgttcagttcagttcagtggctcagtcgtgtctgactctttgggaccccgtggcctgcaggacgctgggcttccgtgtccatcaccaactccaggggcttgctcaaactcatgtccatcgaatcagtgatgccatccaaccatcttagcctctgtcgtccccttctcctctgccttcaatcaagactctcataggcagatattttcgagtgtaattagtgttcatagtttatctaaaagctcatatcacatttaatttttcgttttgttcctgttctttcgaggtactttcttgttgacaagcttgtgacagatagaacgatatagcaatttttaccttagaacaaaccgaggcactatgaacattttgtgcttcatgttgatgactcttagacatgtctacagtagaggagcaaaaaaaattagaggattcaaactattgaatttatcaacagcatttaaatcctcctttttatttatactctaaagtaagaaagaatcaaaaataatcttcactctttttatttcaatattttaacaacactagttgaaattcgggtcttttttacaatacttcttcaaaacatttttctaattcacttatattaaaatcataattatttaatttttcagaaagaattagcaacctttttttctcacttatattattataattgttatatttatgcataaatttattaatgcatattagtacaactacaattggaaatgttgtggataaatatattaaaatattttcccaattaaatgaagaaagtgaattagggatatataccgattgtgcatattcaattattggcgttaaaacagccataacaactacccccagaaaagcaatgtctatatattctctaaaatttctttcttcttttgaatattcgtatatttttgttttcaaatcattagctttttcaggtgtatctatttttgaaatttctaaaaattcatcaaacttaattttactaaatatcttgtcaatagggcttacattaaacagatattttacattaaaacgtaatttttttattcgatttaaattatctatcaatttgattttactagtctcatttaccaattcttctatgagcaaagttatcttttttattatataagattttttgtaataaaaaagataaatacctaatataaacatatatataagttccgctattaaaatagaaaacattaatatatagtacccacctaaatcatttactttcaatctcaaatgttcgaatataataaaaacagcatttgttatgagtgaaccaagaattaaacataccaatatcattgtaattccattgcaagcaaagcgaaattgataattacgaatacatttttgcttatataaatttattatatcttcaaccatttatttattaccccaatcatactattcttttttgttttttatttttcttataataaattaaacatgttttaatgtcaataacagtaatcacatattctccttctatctataatcaaaaaataaaatgtagctctaattaataatataattcagataattataatatagatatataattccgttttagatgaacttaatagaaataaaattcctcagcattttgaataacatttttaaaataataaggacatggcctttattattttttgactatgtgtactaaattgattccatcccagttcaattgttttcgctaaaattaataatagcatctcctgatctttaaaattatttgtaaaaaataccccttctacactatcattaaaaacaataatatcattataatcgatattatttttatcaatttggatttctattatgtcatttatctcttcattttgattaacatatacttttacatatttatatatttttgctttttgcaaaccttctatttgctctgttctataaaggatataaccactatgattgaacaatgcagtatctatatctgttggatcactgttttttagaacaattttgttgtgataactcattttcatcaccctttctgtatccacacaattcggcaaattcatcattcgttagttctaatgcttcagcaatagctagcagataatcaataccaggatttttagttttaccattaattattttacctaaatgagaatcgtttaagtgcgtaatacgacataatttgttaatagaaatattttttttgttaattatatttttaagattttcaaatactgtatttttcttgtaacagtgcaaagaatcggagtctgaagatacattgagtacagtcttcactttaaatctatcggattctaataatgttaacgcttcttcgatagatttattattttcattataattgtagtattcaccaaagtcataaattaacagttcagcttttaaaacatttgcgcagttatgtgttaggatttcgtctctttgatttttgaattttggatcatcataggcagtcaatgcagttaatatttccagtaaattaaacccatcattatttttcaatttcattaattcatctaataactgcaatttatcattaccgcatgctaatttttccacattacatttgaaatcttctttttttgttgacattattcatcattcctttcagtatctcaatatttgaaatataattattaaaaaattatagtaataacataaactttatctatataacgaacatctccactccataaaaaatgaggatattcacaaagacattcagttaaagattctgctatttcaaaataatcataattaatttcaacatcataattgaaaactgcttttaattcactatgatgtttttttaaccagtctaatttatcagcaattttcttttctggaatgtttttccatgcaattatcctgtcatattcatccccaaattcttgccattccccattttcaaatcttaattttaaaatatcacttgaattatccatacaattcataacatatacataatatgtaccatttgcattcggattgctttctaaaatactagttatgatccaatatcaaaggaaatgatagcattgaaggatgagactaatccaattgaggagtggcagcatatagaacagctaaagggtagtgctgaaggaagcatacgataccccgcatggaatgggataatatcacaggaggtactagactacctttcatcctacataaatagacgcatataagtacgcatttaagcataaacacgcactatgccgttcttctcatgtatatatatatacaggcaacacgcagatataggtgcgacgtgaacagtgagctgtatgtgcgcagctcgcgttgcattttcggaagcgctcgttttcggaaacgctttgaagttcctattccgaagttcctattctctagaaagtataggaacttcagagcgcttttgaaaaccaaaagcgctctgaagacgcactttcaaaaaaccaaaaacgcaccggactgtaacgagctactaaaatattgcgaataccgcttccacaaacattgctcaaaagcagctctttgctatgttctatatcttctatatccctatataacctactcattgacctttcgctccttgaacttgcacctaaactcgacttctacatcaactggtttccaatgctcttcaaatttcactgttaggtagacccatacggctgtaatatgctgctcttcataatgtaagcttatctttatagaatcgtgtgaaaagctactaccgcgataaacctttacggttccctgagattgaattagttcctttagtatatgatacaagacacttttgaactttgtacgacgaattttaaggttcgccatcctttgactatttccaattattctgtcggctattatctccgcttcagcttggtcttccgcttcagactgccatttttcacataatgaatctatctcactccacaacccttcatccgccgcggcatcttgttcgattaaattattgacttcatgttgcacattacttagttcaggggaagagttttcttcacgtggttgctcctgatctcctataagaccctgttctctttccacaaacctagaaatgtattcatgaactatggagcacctaataacattcttcaaggcggaaaagtttgggccagatgcccaatatgctttacatgaaaacgtgagaatgaatttagtattattgtgatactctgaggcaattttattatagtctcgaagataagaaaagaatgcagtaaccttggtattgacaaacggggattccatgtatctaaaaaatacgcctttcggccttcttataccctttcccctgcggtttaacgtgcctcttacattgatatctaaaccctcccctatggccgcctttaattgactaatgaatgcaaccgatataaactgtgataattctgggtgatttctgattcgatcgacaattgtattgtacactagtgcaggatcaggccaatccagttctttttcaattaccggtgtgtcatctgtattcagtacgtgtccaacaaaagcaaatgctaaggttttatatttcttataattgtcaggaactgaaaaagttccccttgtcgtctcgattacacacctactttcatcgtacaccataggttggaagtgctgcataatacattgcttaatacaaacaagcagtctctcgccattcatatttcagttattttctattatagttgttgtcattgtatgtcagcactgtaaaaatccatctgttgaagaaggatttcgcggtttttataaacaaaacttttgatacgaaatcgatcaatcaccccagctgcgtattcggaaattcggaaaaaagtagagcaacgcgagttgcattttttacaccataatgcattattaatttcgagaggggattaaggctaatttcactagtatgtttctaaacaatcaatttgtcattaaatgccttataaaacagctatagattgcatagaagagctagctactcaatgctttttgtcaaagcttactgatgatgatgtgtctaccttcaggcgggcctgtagtagggaaaatgacattataaagctggcacttaaggttccgcagactgtagactatacaagcatactccgtctattgtacgatacacttccgctcaagttcttgtcctttaatgaggcattaccactcttttgttactccattgatccagctcagcaaaggcagtgtgatctacgattctatcttcgcgatgtagtaaaactagctagaccgagaaagagattagaaatgcaaaaggcactttctcagtggctgccatcattattgtccaatgtcacgctgcagcttctcaatgacattcgaacacgctttgaagagattcagcctgatattcgacaaactgttttacagaattacggtcgtactggttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcatttttcgcgcttcagtgaaactcattaaaaatatttaacaggtttttaaacttattgatattttttcataatatccttttgtcattggactggaaataatctcaagaccgtagccaatcgacccgtctctttcatatacaaacaagtctccaaattcattttcaagcttttcagcagtattcaaaagacgtctccactgtggctcatctatatcgtagtttttataatcataccatttaccaatagttggttgaaatccgcccatactgcccatcccaccacaacttcaaatttgtttgctaaaattatagcactcaatacgaatttctctatcatttctttatatttgtccatatcgttttatttcactatggaaaattcgggcaccaaagtgtcaaatccacttactattttgaatgttctaatcaataaaaaagtctatagttccaagaatttgcaccatctaatactctccaatacccaaattttaaataccatttttcttttccattcctgtaattgggatactttactgatctatcaaataaagctaaatattttgaattacatttttattcaacaaaaaaagcaactgtaaaaaattgcttaatttattttaatcaattattaaattaccattattaggcttagcagcactagaattattattagatgaactatttgatgatgtactaccacttggtttaatagttgaaatactgttagatgaactactagaagatgaataagaactattattacttgattttgatgtatcacccgaagtaactatgcgaaaatcaccactctgtgcttcggttttctttctagttacaatctttgtagttgttgtaccatcagcgtttgatactgtttcctcaacaattacttcatcagcactcaatggagcaacaacatttatagctacttctttatcacatttatttccataattgtcttctgaaataatttttaaagtataagcaccaattgtatttacatcaattgcactagtatcatacttaacatctgtttgagataaatcatcaattgtataaagaactttaaaatcataagtacttaaatcagtactttgtactatatcaatactttctgcacctgtaattactggggcggtagtatcttcaactttataagtaaaagtttctttttcgtttttatatgaaacggtaactttatattttccaacatctaaacaaaaattttcaatattattcaaatctttatcaacagttacctttgcgttttccaatacatctttttttacatcggtatctaatttttctgtatttaaatacgtttcaggttttatattgaatggtgtaccaagttcaactttaaaagtattttttttcaatacaagataatctggctctttatttaaaacgataaagcctacaatgataaatgctataacataccagtattttttacaattctttaaaatcttttctttcattgttttaaccttcctcacatttttagtatagcatagaatactattgtatacatattgatattggaaattttaatagtattaacggtttccgtcttaccgttaaaacacgatcactaaacctagaaatctattcactcccaataactctaaatttaatgagaaaaatatctaatacgctactcacttttttgtcggtttggaataagtcaaccgttatgcttatattgctttatttatctgactgatatttttttcagcattttcttgatattttcattcgtcaacacaacattagcgttttcagttatactgtattcctcgttttctatgatggtaccatgaaatattttctcgtaatttcaagaaagcatacggaatgacaccaacagagtataaaaatatttctattattttataacattttaacataccagatatttctttaaaatatcatattattgacgaagatatgtcaattttagcgaatagtattgtattggaaataacacattccacaatagatattcctaaatattttgttggatatgtggcaagtagggaattaaaagcaccactcaatattaccacacatattttaatagttctttacgttttaactttcatatacaaggaaactgtactgaacgtttttctctaaagacgtaggtagatgcttttttgaaatataatgctttaaatgaataatagcactcatgccttatgtcctccgatagtattatttctgtctttgccagttgctacaactactaaattcataccttttaatacagcatttttcccatatttctgcttcagtttcaaagttgcctcctgaagtcttttttccttttctaaatctttttcaagctttacttcttctttttttaactgctcgtgatcagtaaacagatccatttgctgtattgtcgattttgttttaatactgctttcatcagtaatatgattagcagacaatgcaaaacgtcttattgttaattttttattaaatccaaaatgctttttgcctgctgtttagccaattcactcctgtactgatctatatagctattaatatcctctaacagttctttttcctttatcatttaaatttatcccccattgcataaacaagatcaagtctagtcctcttttttatcattaggattttgatctttccattcatctggaaatgcaatttgttgtagttcatcagcacgatcaacttcttcctgtgttaatttctcatcattttcaatgcataggatgcgtccgcttgaagctttataaaatcttcccatatagaatacctcaatctaatcttcttcagatggaataaaattattatctccatttatgtagtctgtaattaataattctatttcttccatacagtcaattgtctcaacagttccatcctttaattctacttctaccttggcattttcaatacctgcatctctaaataatgtttttactgtatgtaaagcatacagtaatcttccttttttacttaacattggtcttctccttatttcatttaatttattattataaaacatctattaattcagcaatttcagacgaaagtctatccagtaattcatttacttcatacagcccaatttcttcagcagcgattgcagtttttttcatttgactgatattttttttcagcatcttaccgatatcttcattcgtcaacgcactattggcattttcagttatactgtattcttcgttttctatgatggaacttgttccatcttcaccttcagctgtttcaagtccgaaatcctcaaatgaggtttgaccttcaattacttctgcctcagcagtatcagtcctattctcttcagcatctgactgtaccttcggtgcagtaaactgttttatcagtttatcaacatatcgtccagatatccccagctgatgcccgatccagtcacgtttagttccttcaggtttttcatcgattaattcatatattttttccatgattttaatttcatgaaaacgttcttcaggtttcttttttctctgaatgttatttttaactatcatttcaagttcttctcttgtagagctgggtttatttacaacagatatatttatatatccatctccttcaccagattcacgtagtctgcttattgccagataacgagtattaccgcccagcagagtatatttacgcccgtcttttaccccgtttctgtctatatcacttgcataggcaatagcattttcaaattgaccgtctctacgaatagaattcatcaaagcggtgataaattcattttctgcatcatcataaattgcttcatttaagcagtttattctcacatcatcaatattaacccgtactgtcatacctaaatcttttgtcatactgtctaataatcccatattttattcctggtatatttatgttgaccttattaactgtcaatcatatactttttcctttcatcaaattctctttagaaagtataaatacatgcatttatactttctatgcttagttatcttcaatttattttttattcatctgaacctgcccatctaagcttaaacattggtttttttacttttccgttgcagtagtcactcactgtctgcctgcttatgttaagagctttacctgcttctcttgttcccttataaaaacagtttttttctatatcgtatacaagtttacgcattcgtgtacgacctccatacaagacaccaagctcatttcttgatactgcttttagattgactgcagcgttatcgctttgaaccatgtttctatgaacaatagtatatccgtcaggaatcacaccaataaaaagctcgtatacagatcgtgtaactgatgtttctttcccataaacttttattacccatcgatctgagccttttcgacagctgatcttatacggcttcaaaagtcgaacgttgttcctgtattttcgctttacacaaccgtatgacgaaaaataataatccgtatctcgatactgcttccacaattcgccttttaaattttcaataatttcataattgcccccctaaatctcttaaagttattctcaagttatatcagcaactttaatttaacgtttatgaagtatatggaattcatcaaattcttcctgcgttgcttttctggatatcttatatgctcgctgtaaatatgttcttggaataaacaggttcatattaaccttttcaaactttatatcaatcttctgctccagatctttaaaacctgaaagatatgtttttaccacttccgataatccttcactgtttcttatttttgtatacttgtctgctccctcaaaattgtaaaaaatcgtaacttcatcccctagaagtattacgtgattttctgccccttaccctcgttgctactctcctttttttcgtgggaaccgctttagggccctcagtgatggtgttttgtaatttatatgctcctcttgcatttgtgtctctacttcttgttcgcctggagggaacttcttcatttgtattagcatggttcacttcagtccttccttccaactcactctttttttgctgtaaacgattctctgccgccagttcattgaaactattgaatatatcctttagagattccgggatgaataaatcacctattaaagcagcttgacgatctggtggaactaaagtaagcaattgggtaacgacgcttacgagcttcataacatcttcttccgttggagctggtgggactaataactgtgtacaatccatttttctcatgagcatttcggtagctctcttcttgtctttctcgggcaatcttcctattattatagcaatagatttgtatagttgctttctattgtctaacagcttgttattctgtagcatcaaatctatggcagcctgacttgcttcttgtgaagagagcataccatttccaatcgaatcaaacctttccttaaccatcttcgcagcaggcaaaattacctcagcactggagtcagaagatacgctggaatcttctgcgctagaatcaagaccatacggcctaccggttgtgagagattccatgggccttatgacatatcctggaaagagtagctcatcagacttacgtttactctctatatcaatatctacatcaggagcaatcatttcaataaacagccgacatacatcccagacgctataagctgtacgtgcttttaccgtcagattcttggctgtttcaatgtcgtccattttggttttcttttaccagtattgttcgtttgataatgtattcttgcttattacattataaaatctgtgcagatcacatgtcaaaacaactttttatcacaagatagtaccgcaaaacgaacctgcgggccgtctaaaaattaaggaaaagcagcaaaggtgcatttttaaaatatgaaatgaagataccgcagtaccaattattttcgcagtacaaataatgcgcggccggtgcatttttcgaaagaacgcgagacaaacaggacaattaaagttagtttttcgagttagcgtgtttgaatactgcaagatacaagataaatagagtagttgaaactagatatcaattgcacacaagatcggcgctaagcatgccacaatttgatatattatgtaaaacaccacctaaggtgcttgttcgtcagtttgtggaaaggtttgaaagaccttcaggtgagaaaatagcattatgtgctgctgaactaacctatttatgttggatgattacacataacggaacagcaatcaagagagccacattcatgagctataatactatcataagcaattcgctgagtttcgatattgtcaataaatcactccagtttaaatacaagacgcaaaaagcaacaattctggaagcctcattaaagaaattgattcctgcttgggaatttacaattattccttactatggacaaaaacatcaatctgatatcactgatattgtaagtagtttgcaattacagttcgaatcatcggaagaagcagataagggaaatagccacagtaaaaaaatgcttaaagcacttctaagtgagggtgaaagcatctgggagatcactgagaaaatactaaattcgtttgagtatacttcgagatttacaaaaacaaaaactttataccaattcctcttcctagctactttcatcaattgtggaagattcagcgatattaagaacgttgatccgaaatcatttaaattagtccaaaataagtatctgggagtaataatccagtgtttagtgacagagacaaagacaagcgttagtaggcacatatacttctttagcgcaaggggtaggatcgatccacttgtatatttggatgaatttttgaggaattctgaaccagtcctaaaacgagtaaataggaccggcaattcttcaagcaataaacaggaataccaattattaaaagataacttagtcagatcgtacaataaagctttgaagaaaaatgcgccttattcaatctttgctataaaaaatggcccaaaatctcacattggaagacatttgatgacctcatttctttcaatgaagggcctaacggagttgactaatgttgtgggaaattggagcgataagcgtgcttctgccgtggccaggacaacgtatactcatcagataacagcaatacctgatcactacttcgcactagtttctcggtactatgcatcattcagatctgttttttctaaaaaatcactctcatataatttattggtaaaattatatgaaaactctcttaatttttcatattgactagttgtcttattccactgtaataaatcaaatttagcgttagaaatgttttcaccaaaattgtcagttttattaatacttatttgactgccatttaaccaactgacattaaaacttaatgttcttgggtcactagttacagaaagtgtcgcctctgcttggtatccaccccctggcattatagccaaaggagcatacattgtagaattattaccagctaattcaccgctactataatcttccattttttgtaacggtgctgacaaataaaaagtatcaccaccattaattgaaactgttccactgctaactgtcccttttgttagattatgaagctctaccccttcctgtaaaggaatgtctattgtcacattgctttcagcattaaatgtattgttttcagttctctgagtacttgtgcctgaatcataatatgcacttaaattagttttagttaaattaaatgtttttgtcggtactggcatggactgaatctgttcatatctccatttcaatccaattccattagccaataaatcatcccatgacttaccaccataaatatctcctgagtaagcataactagccataatatgcgtatacagatatttattagtgtcattggtaacttggtcatctttaaaaacatctcctggtccgccataaccgtagtaaagaactttcaatagtgcatcattatttctaataacataaggtgcatattgtccttgtggtggcgtgttttttgaagattcgagacaatacgcaagtgatccattaatataacacattttagtactccaattgcctagccaactaggataataaatttcctgtccccatgtaaatgaaatactgctttgtgccatcactggaaatactgatgacaaaatacatatgatagaaagaaacgtaataataaagcatttaatttttcttgtcattttattttccttccttcttcattatttttctatataactaacaaggatttctacaataaaatttcattttattccctccaaaaataaaaagcaattcaacgaattgctttttatatatatttatcccaatattttacatctgtggcatcacttggaactctccacgattctaatggatcgccctcataacagatatatccatcctcaaaagttgaatctccccacttataagtcactgtacgccaaacttttctttttactggctgagtattttctcccgttgatccagaatttcctccagtatttcctgagcttgatccactcccagaacttccacctgaattaccactatttcctccagaactgttaccaccagatgttcctccatttgaaggcttgttagaaccactactagatgatcctgagcttcctccagtagaacctgaaggtttgcttccagaactattagaactactatttgaattgtttccactagatactactttatttccagatgaatctgcttttttcttaacagtattttttactgttttcgttccgtcagcatttgttactgtctcttgcactaccacttcgtcctcagcaactattggtggagcaattactgttactttaaattctttttcgttcttattcccattgacatcctcaacgtttgctttagcaatatactccataggcacattaacattaattgtactatagtcaatatttaattccatttgtgctaaatctgttattgtaatcagtgatttaaaatcaaatgtagtcaaatctgtcccttgaagaatttctatattttcaggtgctgtaatctctggagcagttgtatctttcacaactaccttaactgttttagtttcatctttatatgttaaatttactttataatctcctactttagcaaaaccacgatctttttcttcagtagtaccatcctctttggtcactgtttcaatatcattttcaatatctgattttattttaaggttttttttcaaatattccttatcttctttatttaatcctctagtatcaactaaagtgtcaaaatctgttttgaattcttttccgtattcaagattaatcgtatttttctttagatgtaattttggtgaagtgtctcttgtagcatatacaattcctccaccacaacccaagacaattaaacctgtaacacagcctgcaatgatcctgttctttttggtatttaaatacttatcaataatatcttttctaatgtccatactttatccctccatctaaattttataatttattactcctgctgtaaatataatccttttcataggtaacggtcattaaccgctgtcttttgaaatactttctggtaaaacacaggacactaatgtagctgcctttgcctttagtgataaatttatagcagtacaggaaactgttaagcttataaagcggatttactgcacacatgaattttttgataaaatcatgtttaagtgaatccgtcatagtaactggaatcataacctccatctgatgggcatagatgttagagtaaaccttcttgttcttctttctgccataggtataagaatgcatgtccttataatcacactgatgtgctatcaccgtcttgtagtctgaccggttgctgaatatatcatgaccggtgttaagccagctgctaatatcttctctggaaccgcatgtagcgtaagatacataagtgttattggtaatcatctgatcgttgtcctcctaaatagacattaaagctctgctttaatgtttttttttatttcagaccatatttttagtgctgaaatcataataaatttggtttcttttataaagttaaacatagttatttttccgctatcaaatattctgtttaattataatttcacccttactttgattttcatttgcctttctatatttttttttacttattttcaaatttatttcgggatagcggtaagatattctataaatagaatttataaattcatttgtatcttcctgtttacatctatttaattccgcagttagaaaattgaagatttttgtagtatcagtatttttcattcttgcttcatttaataagagcctcacaacctcctgtaaagcataatttaacgtatgattgcgcctataatagttataatagtctgtaatagtaaatttgatattattatccaggtaagcaattattaagcacgcattattaaaataataagcaatctgtcgtctgtccaaataaaatttatataccatattttcaaaattactgttcataaagcatctgtattcaacaatctctcttagacggcagtcatacttttgtagaattgttagcatttggctgtatttataataatgttcctctgcttctaattttttcattaaggcaacgaactgttttcctgccgttttaatcgaactatcccctactacgattacagatgtgctaaaagaaggaatataatcatccattttagaaaacgttgcatatactgacttatccattttaagtaaattacggattacttctctcttagcacgtatttcatgcttattaagttttatccactgtcccataattacccctttctatacaaacaaagagagaggttaagcccttatgggtttaacctctctctttgtttgtaatgcattttgtctttagcctttatttattgataaattttgtcttataaccttttattatgttcgagtgtaaatgctcatatcgcaccattttttcacttcgaacaacagttagttaagacggttattaacaaagatgtttttatataaccatttaatctagctaaagcgaagtttaaaaacgatgctattatagttaaattgattttttaatacgatatactaaatacaagttattatttaacttatattttttaaaacatatatatatcaatcaatatatagtatatatatattgttcatcgattctaacttctctttagaattagatggtctcttagagtgatctacggtcaatagacactcttttttgtttgtattgtatcaagttattatcaattttagcacaataatatgattaataaaaacattataacaaaataacaaaaaattcatatgttgcatgataatcagaagtcgagggtgttttttgaaatgttcaaagacattaaattcagtcaaattccgatagactttcgctgatttttctattaaaatcatctacttttttctttagtctcagcagtgcctttttatccttttcaaagttagataggctgatttttgatttcttcagctgctcttcgcatttagaaactgtaactttctcttcatcaattttctttttaatttgtaatcaaatcataaattatgttttttataaacagttatgtatcatttaacacactatctttacggttatatttttgaattatcccattgtgtgcaattccaatagaacagcgtaaatttgtttttctaaggtatatactgtcaaattaagagagttttcatataactctgtcaataaattatatgagagtgattttttagaaaaaacagatctgaatgaaggtaaatttaaggtagaggaaacagtgccagatggatatacagcttcttcgagatacgagcaggaatttacattagatggttatatcgacagaagtgtttttacagcaattattgaaggtaaagaagtaaatgtaaaattatcgtctacacttgcggacaatcattacataaaatatgaggtggatggtgtaccagatagtgtaacagagattaaatttcctacatggtcgattaatgggggacaagatgatattgattgggttcaccttgcaaaagaaagtgacggagtatggcgtgcaaataagcagatgcctgaaagtggacagtacgtgattcatatctattataatactgctgtacagcaaaatatttattctcatgcagttaatttttggccgagtgatacaacgatcaatgttgtaaacaataggataatgggtaaaatatctgttgataaattagattatcatgcaggtgaaaaattagcaaacgcaacatttgatgtgattgccagaaacgatataagaacaccacagggaactgttatatataagcagggcgaagtggtaggaaatcttacaacagatgaaaacggttatggtgaactggataatcttaatttgggggaatacaccctaaaggagtctgcagtaccagatggtttccgtgatgatgacagtacatatgattttactataactgctgataaaactgattctaaactacatatgggattagatgtgacatgggaaataaataactatcctacttttataaatgtttataaagttgataaggattcgggtaaaaaacttgaaaatgctgaatttgatttatacaacgttacagataaaaagaaagtaggaacgtataaaacagataagaatggcaatattgctgttttttatttatcaagacagaaaacctattatcttcaggagacaaaagcacctgactcttataaattaaatgataccaaatattatttttatgttgatgagaagggggcattcagtgtttcagatttgaatggcactgtagaagatggtacttttaatgtgccgtttcacggtacaatgaccattactgttaaaaatgaaatagatatatgcaatcttcgaattacaaagaagaatgataacagtaaagtattagagaatgctgaatttagcttatattctgataaggaatgtacaaaggaaatagaaaaaggaaaaaccgacaagaacggtcaattgaattttgatcggatttctgttggtgatttttatttaaaagaaacaaaagcacctgcaggttatcgtctgctggaagatccaattaaaatatcattgaaaaatgtgaacgggaagttcactttttttgttaatgatatagagattaaagatgatgataaaaataacagcttaacgttagaaaatggcttatatacaggaaatttaacagttataaacagtcgaggatctattcttcctgcaactggaagtccaatgacgattgttttaacagcagcaggtgttttatgtttattaattacaatcaaaaggggaaaaaacaatgatgaagaacaaatttaaaaagttaggaataacagctttagcttgtgtactgtctttaacgacagcaggaacagtagcaaacttagttaatagtggaaataatggaaacggaatttttacgaaactaaatgctgaaggaacaggacatataactattaatgccaatgtaggagataatggggttactcaaagtctggcagggaagaaatttaatatttaccgcatctttgatgctcaaaacagtgcaggaatggaaagtattaactatacaatgaatcctgcatatgaaaaatcattgaaaaaggttactggaaaagatacagaatatgcaatcatagattatattcaaacattaaataacaatcaggtgatcaatgatgtttcacagacacagaaaaatgagactgcatattctaattttagatattttgttgagagtctaagaaatatgttagttgaagataaagccgaccctactatggggtcgcacagagtcggacacgactgaagcaacttagcagcggtagcagcagcaagaatacacagaagaactgtacaaaaaagatcttcacgacccagataatcatgatggtgtgatcactcacctagagccagacatcctggaatgtgaagtcaagtgggccttagaaagcatcactacaaacaaagctagtggaggtgatggaattccagttgagctatttcaaatcctgaaagatgatgctgtgaaagtgctgcactcaatatgccagcaaatttggaaaactcagcagtggccacaggactggaaaaggtcagttttcattccaatcccaaagaaaggcaatgccaaagaatgctcaaactaccgcacaattgcactcatctcacacgctagtaaagtaatgctcaaaattctccaagccaggcttcagcaatatgtgaactgtgaacttcctgatgttcaagctggttttagaaaaggcagaggaaccagagatcaaattgccaacatctgctggatcatggaaaaagcaagagagttccagaaaaacatctatttctgctttattgactatgccaaagcctttgactgtgtggatcacaataaactgtggaaaattcttaaagagatgggaataccagaccacctgatctgcctcttgagaaacttgtatgcaggtcaggaagcaacagttagaactggacatggaacaacagactggttccaaataggaaaaggagttcgtcaaggctgtatattgtcaccctgcttatttaacttctatgcagagtacatcatgagaaatactgggctggatgaagcacaagctggaatcaagattgctgggagaaatatcaataacctcagatatgcagatgacaccacccttatggcagaaagtgaagaagaactaaagagcctcctgatgaaagtgaaagaggagagtgaaaaagctggcttaaaactcaacattcaaaaaacaaagatcatggcatctagtcccatcacttcatgggaaatagatggggaaacagtggaaacagtgagagactttatttttgggggctccaaaatcactgcagatggtgactgcagccatgaaattaaaagacgcttgctccttggaaggaaagttatgaccaacctagatagcatattgaaaagcagagacattactttgtcaacaaaggtccgtctagtcaagctatggtttttccagtggtcatgtatggatgtgagagttggactgtgaagaaggctgagcactaaagaattgatgcttttgaactgtggtgttggagaagactcttgagagtcccttggactgcaaggagatccaaccagtccatcctaaaggagatcagtcctgggtgttctttggaaggaatgatgctaaagctgaaactccagtactttggccacctcatgcgaagagttgactcattggaaaagactctgatgctgggagggattgggggcaagaggagaaggggacgacagaggatgagatggctggatggcatcactgactcgatggatgtgagtctgagtgaactccgggagttggtgatggacagggaggcctggcgtgctgcgattcatggggtcgcaaagagtccgacacgactgagcgactgaactgaactgaactgaaggcaatggcaccccactccagtactcttgcctggaaaatcccatggatggaggagcctggtgggctgcagtccatggggtcgctgagagtcggacacgactgagcgacttcactttcacttttcactttcatgcattggagaaggaaatggcaacccactccagtattcttgcctggagaatcccagggacgggggagcctggtgggctgccgtctatggggtcgcacagagtcagacacgacttagtaactaaacaacaacatgctgtctagtatgtggtgacaacaactgagcaaagctgtcaagggttgtagagtcaggtccctggctgaaacctctggtagacacctgaatagcctaaacctgcatgttgtcttgcagatttatcgttttttggtgagactaatgaatttctgattatagtagaaaattcgattgcagagaaccataaatggttcggtaaaccactacattgcagttgagtacggcagtcatctaataaggtacggtttagccgttcagcgactccatgtgctcgggaatccgctgtggttgtatagcatggagttataccattttttttttcaaggaatttatggagagttctgttagtatactcagaaccacggtccatttgtataaccaagacactggcctgaaactggtttttaataaaagctagtatcgtagtaaaaacatcgaggatagagtcctcgcgacggtcgtgtaatggataaacccaacggaattttgttgtctcatcagtaaatgagatgaaataggatggtgcactttttggtaggttgtgaactggaccaaatatgtcagtatgtaggtattgaaagggttcgtatgaattttggtattttagtcgtgaacctttgatatgtctgtgtttggtgcttttgccgattaaacaatcaggacattgatagtcaatagcactagaccagtcgacatctgattcgttaaaatacgtgatggtgttatttttaagtgagtatcgaattgtctgtgcattggcatgcgcaagcattcgatgaatgaaaggataaggatatttgcgtgtactttcacttgtatggacattattgatggtgggtacggagatatttgatggaagcaagtactttttagatacccagtaaaagtctccatattttacgataggtgcaagtacagtgccgtcagaccgttctaagacgtttttggtaaagcatgctgtgatatctactgcagccaattcattcaaactgagtaagtcataggctatgttaggagtgtgcaatacctttattgatgttttggtgttgtcctggaagtgaaattgtaggtcaccaatagcgttaattggtatatttcttttttgagcatcaactacgtttatgtcaggattagatgatgctgagtgtatgtgatgagcagatcttataagggttcgtgatgctcctgaatcgagaaggaggtgtccagggagttcatcatcagaatgattagtatgatttactgtagattcagtaagtttctggcctaagatgaaggtcgtgcttattgttcaattgaatcggttcagtagttgatttactgatggaatcgttgtccgtgctgggagagttattagatgtggatacattgtgagccctggctgttttcgatttcgaattatttgttttttgaggattccgagctataactttgggtttggttgtattcgtatagctgcgagaatcattcttctcatcactcggatttctcctgtaattaggtttgctgtttctcgatccctgttgttcttcataaatagcatggatatctaagaacagttcagcgactgtcatatttagatgtcgatgacgtgtgtagcgtaaaaatttatattcgccagatagacctctcataattaattggcatgcgaccttgttattgatatgaatgccattattgttcagtctgtcgataatgtttgtgacttttgtttcaaatgcatctgcaggtgtactgccattatattgcaaatttgccagggtcacaatgtcgtttgcctcttgggtatcagattgcattttttcaatacttttggaaagaattttcatgatatccgtataatcaacggataggatgtctttgacccaggtaggtaggaattgagagggagcaaatatttgaaaagtgttatacaagaaggtgagttcatcatcagtgatctgacgtacgggttttccgtttactgtcggaataataccaccgagattcgagttttgtaaaaatttgatgtatgttttaacccaatttggaaagtcattaggtgaggttaacattggtggtggtctgacatattttttagtggatgtcatatctttgaatatttcaatcattagtgcgcattctccatctatatttacgaagtaaattaggtggagtaagcactttttttattggttttcaatatattgttttactacggcttctgtagtatcagatactgctcctatataataagagcggttccaaaaatatggtttccagtaatactgtttaagatattcagcatactcttttcttattcttcgagacgatactgttttaaagttgtttatcaaattagctaaacacacttgtggtggtgcttcaaacaatatatgaatatggtctgtttgagtttttacggaaataatattacacccccacttttcttcaaatatataatacactatatttaagatactactattaagttcttcgtttttaaatacaggatgtcggtatttggtcactacaactaaatgatatttaagattaaaacatgcgtgcctattcttactataatttaacattttatcacctcgtgttccttaacaactaattgtttttatggtataataataccgtagttagcgaggtgatgtcaatgaaatataccagttcttataaagtaaaaattattaatgaatttaaaacaattaatcaaacagtatgcatttatcaaagagcggtgaaatatatcattgacgtatctctggaagaatatgaaagcattaaggacttaagtccaaacagtgctatgaactatatcgaaaaactaattcatgccacttcatcaagagaggcaaaatacaaaggctttaatcaaaagttttacaaaatgcccagctatttaagaagaaatgcgattatttctgctaatacaattgtaaaaagctataaatcacagctggagcattggcaaattaatggaggtattggtaaaaagccaaggcttaatcgtaatcaattatcgatgccatgtttatatagaggcaatatgttttctttaaatgacgatgggacatgtaacattaaagtatttaaagacaatgattggaaatgggttaccgttaatctaagagcaactgatttagcttatatcaccaaaagattcgatattaattcatcatcagcacccgttattcaaaagataaatcaccgctattacttgagatttgtgtttcaaaacaaagtagaactgccacaaacatctgatgctatatgtgcagttgacttaggcatcaatcatgatgctgtctgttctataatctcaggagatggcactgtcaaagcaagaaaatttattaattttgctaaagacaaagactatctcaacagattaagaaaacagataagagaagcacagtctcggggcaacagacaccctaataaattgtggcgtcttcataacagccgtaatcgccagctgtcaattcaaatagcccgagcgattactgtatttgcagtcgaacatagatgcgactgtattgtgtttgaacatcttgatttaaaaggtgtcaaatccaatcagaagataacgctatggcgcaaaagagaagtacagagaataacagaatcactagcacataaaaatggtttaagactagctagagtatgtgcttggaatacgagcaaactagcctatgatggtagcggtgaagttaagagaaacaaagataattatagtctttgtacttttagtaatggaaaacaatataactgtgacctgtcggcttcgtataatatcggagcaagatattttattaaagatatcatgaatgggttaagcagtaaaataaaatcccaagttgaggcaaaagttcctgaacttggtaagcggaccacatgcactctgaacagtttaattaaccttaatgcggtgctgcagtaataatactgcagttactgagtcaaggctgtacagctgtcagaaatccgacgctctctaaaggagcaagttttagatttataatctgaagctgaggtcggaagcaccatctatatttacaaagtaaattaggtggtgaggttcacatcattcagatctgttttttctaaaaaatcactctcatataatttattgacagagttatatgaaaactctcttaatttctcgtaacgactagttgtcttattccactgtaataaatcaaatttagcgttagaaatgttttcaccaaaattatctaccttgtttatattaatctgacttccatctaaccaatcaacacttaatgttatttgggtgggatcataagtaaaactccaagaacctatatcttgaacactggtactgtctgattttacaatcagtggagcatatcttgttttatggctacccgtcagtgttccagagctatagttatcatgcttattcgatatatctgtttctaaataaaaagtatctccaccataaatggttgcattattaatagaaacagttcctttcgtaacattatgtagttttataccattttgcaatggtaatgttactgtattactgctagtagaattaaacttaatatcttttgtacgctgggttcctgtatttagatcataataagcagtagtgttaaagttagtgctaccatcaaaattaaattcatttgatggaattggcatagattgaatctgttcatatctccatttcaatccaattccattagccaataaatcatcccagttcttgccaccataaatatctccactgtaagcatatgaagccatgatatgcgtatagagatatttattagtatcattagtgactagatcatctctaaaaacatcctcaggcccaccatacccataataaagaactttaagaagttccatattattactgatttcagcataagcactattgttatttactggttcatttcgagaagaatttaaacaatacgctagttgaccattgatataataatagttagtagaccagtttcctagccaactcggataatatattggactgcctttttcgagttttactgtttctgcgtgtaaagaagaactggatattgagaatattactccaccaaaaagtaatacagcaacaagtaaaaatttaatgaacttattccaaacgcttcttgtactttttaaaatcatctttgccctccttttcaagctttaaaaaatgactttctccatattaatgtaggatttctacaaagaaacataatattttccccctttataataaaaaaagcaagcgatcttacgcttgctttaacatataatattatccaaatatatcgtcaaaatttccttgtcctcctccccaaatatcagtatagccaccattttgagttgaaccagatatatctacatccgcacttccaccagttgaacctgctccgcttccagaacttccacctgaattaccactatttcctccagaactgttaccaccagatgttcctccatttgaaggcttgttagaaccactaccagatgatcctgagcttcctccagtagaacctgaaggtttgcttccagaactattagagctgctatttgaattgtttccactagatactactttatctccagatgaatccacttttttcttaacagtattttttactgttttcgttccgtcagcatttgttactgtctcttgcactaccacttcgtcatcagcgattgcaggtggcgcaattactgtaacctttacatctttttcagatttatttccatttatatcttcaatattagcttttaccatatagtcagtaggtatattaacatctactgtactgtaatcaactgtcaattcattcaatggtgctagatcagtcactctaatcaatgatttaaaatcaaatgttgccaaatctgttccctgtaatatttctatattttcaggtgctgtaatctctggagcagttgtatctttcacaactaccttaactgttttagtttcatctttatatgttaaatttactttataatctcctactttagcaaaaccacgatctttttcgctatcatgcactgattacttggctgatcatacactgatcacgtgactgataatgcactgatcatctggctatcatgcactcattacctggctatcgtgcactgatcacgtggttgatcatacactgatcacgagactgatcatgcactgatcacatgactgcccatgcactgatcaccaggatgatcatgcacttatcacctgactgcccatgcactgatcacgtggataaacatacactgaccatgtgacaggtcatgcagtgatcacgtggctatcatgcactactcacgtggctgatcatgcaatgatcatgtagctaccatgtacaggtcacgtgaatgatcatacacccatcaggtgactgatcatgcactgatcacgtggctatcatgcactgatcacgagactgatcatgcactgatcacgtctatatcatgcactgatcacatgactgcccatgcactgatcacgtggatgatcatacactaatcatgtgacagatcatgcactgatcacgtggctgatcatgcactgataccgtgactgagcatggactgatgacgtggctgttcgggcactgatcacgtgtttatcaggcaatgatcagtgactgacaggcgctgatcatgggactgtgcacgcactgatcaggtggctgatcaggaactgaccacctgaccgcgcatgcagtgatcacgtggctggtcgttcactgatcacgtgtttatcatacggtgatcacgtgactgagaggcgctgatcacgtgactgtgccgtcagtgatcacgtggctgagcaggcactgatatcgtgactgagcatgcactgatcctgtgccgggagccggggaggcattccactctggacaaaggtcatgaggaaggaggctcggcatacgcaaatgcgggatcgagcctcaggagtccacccggatgttctcgagcatctccccccaaaaaaaaccggagtctgcctactgtattgctttgtgctctcacctgtgatttcactgggggctgtcccccaccaccatctcgctctctctgtcaaagagttaacttacagctccaattcataaagttccttgtcattcttccctttaacttccagctgagtctccatctggagcgcggaacccaccacgcttactaattatgcctgggctgctaagacccactcgagaaggtgtctagggtgaggcacctttcgctattcgagagggcgcctgcggcctacgtaagtggtgcaaacttcttgtcttgaagtttgattggtcttccgcgtaaaccaagctactcagtctcttttctccaccgaattttcctactgagctctcctcatactattattcttgacatctctgattagcatataaatagtcgcctaggccatctctccttcgaataccctggatcagttggggctggtccccggcaggtggcgaccgaacagggacctcaggaggcaatactcaaagagctgagcagacacgaaccacgcaatcagcaggcaataagcatggagctcagcagtgacgaatcatgctgctcaactggcaataatcaagcacgtgaccaggcaggaatcacgcagctcagctggcaattgtcaagcagatgagccgacaggaatcacgcagctcagatggcaattgtcatgcagatgagccggcaggaatcacgcagctcagcaggccctgatcacgtgactctgcaggcactgatcacgtggctgatcaagtccagatcacgtgactgagcatgcactgatcacgtggctatcattcactgatcacgtggctgatcatacattctataggaatttggattcgtctgataataacagtatatcattccaactaaaagggtacctgatttatggtacccaaaaaagtgtcagaaaattactctttcctgaacattgttttattacagttgggacactggcagctgtatctcctgtctttggatccgctgcttagttccattcctaaaaattcttctaatatccagtccggtactccttcttcatatccgcacgattcacatttcatttcaatcagtacttcatcctctattaacgcctcaagctcttcttccgtatactccattatctggcggcttttttcttttcctgaggtattttgattcatagatgcatttgtttctgtattgtcggtcatttttgatatctccttcaaagggatcataggtttctacgtattccattatctctccacatttacacagcagcggatctctttgaaatgattttatcatattatatctgaaatgtgtcttattttgtttaatttttgcagctgctttgcgttctttttttaactgtgttcttcgtctgacttttttgccaaccagtactgccatcttatcatatgttttggaacttttattcgaatagaatccaaaatatcttaccatcttgaagttttcattgggacagtgaagaactacgttattaataaaggtttctaccggttctgtaacgtcaattcttttttcgtcttcatgacgatgatagtaccagtgaaccgttctgttcacatcatcatatttaactattcggctttcagccataaccggtctgctcgtatatcttgttatatatttaacgcattcattaatatcttcttcatcctggtctttctttgatctgggggcatggatgtagaagccttcagtgtattttgtatagaaccagagttttagtcttttaaaggtttcattatcaccgattctttcatcgagatattcaagaagctgataacgccatgtttgtcttaactttttataggacatataagcaaagcttttaatcttattgttctttttatcgtatccatcttcacagaccagaacgtggaggtgaggattccactgcagagaacgtccaaatgtatgaagtgaagcaacagcaccaaaaacaatattatctttagtatccttatacaggtattttgatttatgtttaggatgtttatacataagatcatttttatgtctggatttttctttacggtatttgcggtcattgaatacacaggcaaggacattgcgagcaactacaaaaaagctgtcaagaagagtacgatcccttagaaagaaccacctaagctctttaggaatagtgaaaacaatgtgacgatgcttagattcgaaagccatagcagaaacaaaagcagcgcgccgctgggaagctttagaaccgcatttggagcagaatctggaagagcaggtatgagcgacgatagtctcctggccacagtagggacactcataaagatcataacccagatagatagaagagcataaaatagttttttgaatattgtcaaaggtaacatcgcgcattttaccggagttatgtagtttggaaatataatcaaagttgtcaaaaaagatatatctaaaagtttctttaccggcattttgaacgtactgactaaagttaagaagacttgaggtatcaacaggaacagctaaatcaatcattatatatcaccaggtatattataaaacaaaaaaaggtgataatcatctgtagtgattaatcaccccgtggacaaaatttattttgtcccttttttataatatatgcgctgttgttttaatgtaaagtaaaagagttgaataatattcaaaaaatgttcacttttttgaaaaaaattgtgcctttttgaaacaaaggttatgctaaaattagtatagttaaaattatgcaaagaggcagaatgcctcttttttgtctttaattttaagaaattattaaggaaagcaggtggaatcaatgggtttagaagaatcttcaatgaaaaaagcaacaattcaaatgaatttgtttgactatttttatgaacaggacaattttaccataaaagaagctactgaactggtaaaagaagttagaggaaaaagagtaaatgatgaaagtattagggcgagaatatatgaaggcatagatagaggaatcttcaaaagagtttctcgaggcgtttataaggtggagagccaaataaacggaacaacaaatcaatgccttttaattaatggtgacggcagagatttatcaatgataaaagataattctattgatgggataatcactgatcatccttataaactgcctaagcagttaaaaggcggtaatcgaaattttgcagaatatgaactttttaaatatgaggaaaaagattttaaagagaaaagtcgagtactgaaagacggtgcttttatagttgaatttttacccgaggaatcagaaatcaactatgagtatctgtacgaaataaaacaaatggcaaaaaaagcgggttgaaatattttgcgaaagtaccatggacaaagggaaattctgtcgctaatactggaagaaaatcaaaaaatactgaagatgttatgattttttcaaagggaaaacccagatcattaaaacttaatgcaaagaaaaacattcaaactgcattaaataatggtctggatataaaaggaatggattcatctcaggtcaaagcgttattagaggaaaataatttagttgttcattacatgagcggaacatcaagtatgcttcctacgcagtttaactatcagccgaaaagtataactaaaagagtatatcagactgaaaaaccagtcgagttgctagaggaaataatcagttatatatcgcttccatatgaagttattcttgatcagtttgctagaagcggtaatttagctgtagctgcattgaatatgtccagaaatgcaatcgttattgaaggagttgaaaatatacaaaatacctcacaggaaaaaagaaatttagcaaaagaaaattttaatctaatgaaaaaaatatagaagaacagctggataaaaaagctactataattgatataaatcctattacatattccaatgaaagtactgtaggatatgagaaattagaaaatgattatgatttagaattataatttggagaaaagttatggaaaatgaactaattaaaactaaaattgaaaatcttatcaaagaaacaaaacaacttaaaattgacgatgtaatatcatatataaaaattaaatttcctgaaaatgaattcagttgggaaaatattgatgaaagaagtgatttttattatgatcgtcgagatattattcatttaacaaatcaaactgatttgattattaattatcctgggggtgacagatttggtgatatattcgctgaaccatatactgatataagttttcataatttaaagttgattaataaatatgatgatttggaagataaattatacaaaataaagctatagacagtttaaaggtaggacgttcgagaaagaattatcgatacatatacgataatattaaggcaggtaactatataaaattcaagtgtttttatgaaaaagtttgaaaatgttaaaataaatgattttatatgttaagtagtataaatccttgaaatgtgaataatgatttgtaatttttgggcatgacgaaaagaaccaaaattggcctttttttaattttaatgcatttattttatcttaaaagtgcatcatcaaattgttgattggtacttgaaagatgataaataattctaagcaattttctaacacaatgtccacaagcacaacgatgacctttaccttgagaaatctttaaatcataatattgtttaaataccggattattattaatcacaggcaatatgatctgatataaagtctttctcaaatatggtgaacctttcttggtaatagcagtatgttgtgcgttgtattgacttgattcgtaatgataaggagcaacaccagctgcttttattatcttagatggcttagaatagttgcttatctctcctaattcggctaaaatagaagtaccagagaaatgagaaatccctgggatggataggataggagagttattttggatggaaaactcttctatttttttatctgtttcagctaactgttcattgataagttcaatctgacttatcagatgtttgattttgattacttctgctgctgatgaaattccaatagaagatttagcagagtctttaagctgctgtgcagttagagatatgcggttccctcggccttttatttcaaaacatttgcgaatagttctaatatcagtactagcgatattttcagcactgccaaatgttttaagtacattcatgtagataatgccgtatttagatgaaaataagctgttgaattcagggaaaacaatatcaatacatttttgtaggcggtttgtataaacattgagttcttcttttaaattgtgatgatgtctagttaattgcttttgttcataaagatcgaagctgttgacttttgtaatacgatactgcttttttcgtacaggagtatccaaaacatcacagatagtaagagtgtcaagtttatcattcttagtgatgccgttctgcattttacgagtgtaatcagtagttttagggttgataagagcaacagtaaaatttttttctaaaagatactttaataaagcaaaatgataatgcccggtgtcttccataccaatcaatatagagtccttagaataagaactaagtttttggattagagaatcaaatccatctttagtattggaaaaagaagaaggttgaagtaaaacttcaccactatctttgtccataatacaaaagaagtgtttgttttttccaatatcgataccaactaatttcataataaaagatcctttcttgataaaaatatgtgaaaaggtatccacaacacttagaccacaaaacctggtgcaaaatacgaattcaagactcatctaactaatcattatttaggaataaggttgtggtaagggcctgcctaaagtagtcatgctacaaggtgaaaaaatacaaatccacattcacatattaaatattttacaaattaacttaaccgtaatcaaccacggtttaaatggttgatagaaaggagaaggtatatttgtagatgactattaaatgagtcaattacaatataccaggtcagtgcatgatagccacgtgatcactgcatgacaggccacgtgagcaatgcatgatagccacgtgatcagtgcatgatcagacacgagatcattgcatgatcagtcacgtgatcagtgcatgatcagccacgtgatcagtgcatgaccaggcacgtgatcagtgtatgtccagccaagtgatcagtgcattatagccacgtcatcagtgcatgatcagtcacatgatcagtgcatgatcagtcacgtgataggtgtgtgatcagccacgtgaacagtgcatgctcagtcacgtgatcagggcctgctgagctgcgtgattactgtctgctcatctgcttgacaattgccagctgagctgcacgattcctgcctgtcatctgcttgacaattgccagctgtgctgtgtaattcctgcctgctcagctgcttgattattgccagctgagcagcatgattcctcacagctgagttccatgattattgcctgctgactgattcgtgcctactcagctctttgtttattgcctccagaggcacatgatcagtgtatgatagcaaacatgatcagcgcatgatcagtcacatgatcaatgcatgataagccaggtgatcagtgcatgatcaattatgtgatcagtgcatgatcagtcatgtgaccagtacatggtagctgcgtgatcattgcatgatcagccacgtgagcagtgcatgatagccacgtgatcagtgcatgatcagtcacgtgatctgtgcatgatcagtcacgtgatctgtgcatgatcagtcacgtgatcagtgcatgatcaattacctgatcagtgcatgatcagtcacgtgaccagtgcatggtagctacgtgatcattgcatgatcagccacgtgatcagtgcatgatagccacgtgatcagtgcatgatagccacgtgatcagtgcatgatcagtcacgtgatacgtgtgtgatcagccacatgatcagtgcatgatatccacgtgatcagtgcaggatagccacgtgatcacttcatgattattcacgtgatctgtacatgatcagtcacgtgatacgtgtgtgatcagccaccggatcagtgcgtgatgagccatgtgatcagtgcaggatcaattatgtgatcagtgcatgatcagtcacgtgatcagtgcatgatcagtcacgtgatcagtgtatgatcagccacgtgatcagtgcatgatcagccaaatgataagtgcctgatcaattacgtgatcagtgcatgatcagccacgtgatcggtgcatgatcagtcacatgatcagtacatgatcagtcacgtgaacagtgcatgatcatttacgtgatctgtgcatgatcagtcacgtgaccagtatatggtagctacgtgatcattccatgacgagccacgtgagcagtgcatgatagaaacgtgatgtgtgcatgatgagttacgtgagcagagtatgatcagccacgtgatcagtgcatgagtgccacgtgatcagtgcatgttatgtcacgtgacaggtgtgtgatcagccacgtgaacagtgcatgttcagccacgtattcagtgcatgatagccacgtgatcagtgcatgatcagttacgtgagcagtgtatgatcagccacgtgatcagtgcatgacaactacatcgttattagcatttaacttaatttcctcagttctttgctgaccattctcataatatgcgttaagactcgattttgaaaaattaaattcatttgttggtacaggcatggactgaatttgttcatatctccatttcaatccaattccattagccaataaatcatcccagttcttgccaccataaatatctcctgaataagcataactagccataatatgtgtataaagatatttattagtatcgtttgtaacctgatcatctttaaaaacatctccaggtccgccataaccgtagtaaagaacttttaaaagagcttcatttgtatcaataacactatttgcatattgtccttcaggtggagtatctttagaagattccaagcaatacgctaaactgccgtttatatagcacatttttgtagaccagttcccaagccagctcggatagtaaatttcctgtccccaagtcagattagatgtaaaagcactcacattgataaaattattgagcactaaaaaaatagaaatagataaggtaaataaaatttttaaaaaacttttatattttctcatatcttttattcctcattattattttttattcaataggtcttacttatccttttcgataatgcctttaataatattgacggctttcgccgtcaatatttagccctcataaatataaaaaatatcataatttatcccctattctgtactttaagaataataaaagatggctattataaacaaccatctaatatcccattatttgtttgtactcttcataagttatactcttcttattaaaacctgagaaatcataagcatcattcggtaatgacatagcatttggattccacttttcttctctacctgcccaagaaccattaaatgttctatcaccaactttataagaccattctacataaatatattttttagtagtttctcctgttgatccagaatttcctccagtatttcctgagcctgatccacttccagaacttccacctgaattaccactatttcctcctgaactgttgccaccagatgttccaccatttgaaggcttgttagaaccactaccagatgatcctgagcttcctccagtagaacctgaaggtttgcttccagaactattagagctgctatttgaattgtttccactagatactactttatttcctgatgaatctgcttttttcttaacagtatttttaactgttttcgttccatcagcatttgttactgtctcttgcactaccacttcatcctcagcaactgcaggtggcgcaattactgtaatctttacatctttttcagctttatttccatttgtatcttcaatattggcttttacagtatattcagcaggtacattaatatctactgtactgtaatcaactgtcaattcattcattgttgctaaatcggtcgctataatcaatgatttaaaatcaaatgttgccaaatctgttccctgtaatatttctatattttcaggtgctgtaatctctataggaaaacctgtctggtggattgatttagtttattttttaaacagatctggtaatgaatttgaagtagaacttaaatttgaagtagaacttaatgatctaatcaaaaaaattaaaaattcttataaaaaaggcggataagacaataaataagctgttgtgtttaataattagctatggaagtaaatagaaataaaaatttaaataaagtaaataagttttgctttaacagatatggtgggtgatcagatgaaaaagaaaattttagatgtatgctgtggatctagaatgttttggtttgataaagagaatgaaaacacaatatatatggacaaaagacaattagaggatactttatgtgatggccgtaaattaatgataaatccagatgtgattggagattttagaaatatcccttatgaagataattcttttaaattagtaatatttgatcctccacatttagtaaaagcaggagaaagttcatgggtggccaagaagtatggaaagttaaatgattcgtggccaatagatataaaaaaaggttttgatgaatgtatgagggttcttgataaaagtggagtattaatttttaaatggaatgaagaacaaataaaattaaaacagatattagatttaatagactataaaccattaataggcaataaaagagcaaagacacattggttagtgtttatgaaagattaatccgctatttttaagtatgcaaaaaataagaatatagggggatagttatgaaaaaagaactgcttgaaataaatgaaatggttaaaggtgatgaaatagcagaaaaaattatgagtgatttgctggatgtttattataaaagagaaagaattggagagtttagaaaaaagctaatacatttttctaaaccattattaattataattgcagaagcattatttttattgacaggtttagtattagcgttcaatgtagataagagactagatccatatttgttaaacccaatagtatttcctataatacttccttttggttttttaatgattttttatttgcagttaaaattatcatatatgcttgaagatgtaagtgataaaattaatgagaaatatttatataaaatcaaggatggtgaactggattatataaatgacattttgtatgaacagaaagaatttaagaaaaaatacgagataataaaaaaaggaagcaacaggtacatagattatccaccattaactaaaatacggaaaaagaaaaaatgcaatgagttagaaatttatagttattatcagattaataagatatcattcgataaaattgatattgattgttgggaatgtaaaatatggaagtaaatagaaaaaattggatgattaacatctgtggtggttactaaaaatttaaataaagtaaattagttggttttagctatggaagtttatctgatctgataagtggtcgttctgcaatacctagattagatactattgttaaaatagctcttctcagagccaccatgagaagccccctgaggtcacctgcacaagtcgagggaacccagggtttcctgcctcaacccgggaaagccctcgagagaccttcttcaacacgtctcgaggccagattcccctaccatggctcgggagcaatgacgcgctccccctcgccactcgcatggagacccgacttccctggcgccccacgagaggctcactgacctcgccgtcgtacctcgtgagaaaccgcacactggggccgccgctcgagaacaaccccgagattcccccgtcatcgagagatgagggccttcgtctcctgcatggcctagagaccaatctcgcgacctctctccaaacgcctcaggaggcttgactcccttgagtccacccagtgagctccaagagatacccgtcgcgactcgagagcagagcggggttctttgcttccactcgagatgaatgcctgtctccccgggtgcgtctggaatgcaaccccgagatccctgtcgcccctggagaggaacattggcttctggacacaagcctagatgaggtctattggccctgcagtcactcgagagcaatccccagctttccttcgcaactcgaatggaagattggacttgcctgggccaacacaagaggcatcctgaattccccgtcgtaactcgagaatcccgccgtaactcgagaaaaaccacgtggctcccccgccatcgcaagatgaagccctttcccgctacagcgcctcaggagaagtcccacgttaggaattggaggtcgaaagggcacttggcacccttgatgcgacccacaaagttccccgaaatcccggtctccctcgagaggaacaccgaggttttccggcaccccctcctctgagccctttctcccctcctgatctggacaggagggtcgactcccctgctttgtctggaaggggttcccgaccttccggtcgcacctcaggatgaggccggtctcacgaagacattccagacgtggcctcgtgggtggttccacattccgtaggaccccgatttcccggtcccctcttgataagaacccgatgcccggacacctctccgaactccaccctgtgaatgaagtcaacacgaaggggcagtttttccgtgcatcgttcggaaaaaaccccaggttccaaagacagctcgacaagcggcctctctccccggggacatctcgagaggcaagcggagttccatgcctcaacccaagacgaggcctgactctcctgtccccagtctgcagggaccctgcgatcggagtctgaaatcagaggtaccctgcggttcctgcctcaactggagatgaggccctcttccaatgcaccaaacccagtggagtcccgagaggcccctcccacctccagtttccctggcttctcagagccaccatgagaagccccctgaggtcacctgcacaagtcgagggaacccagggtttcctgcctcaacctaaatcatcaccattagtggcaataacttttttgtaccaatagaatgaatctttacgataacgatctaaagtttttaaatcaaattcttcacggtctacataaataaatccataacgtttgaccataccttcatgtgttgaaatcaagtctactgctgaccatggacagtatcccatcatttcacaaccgtctgtgattgctaattgtacctgttcaagatgttttcttaaatattcaattcgatattgatcatgtactttaccgtcttctgttaatttatcatatgctcctagtccattttcagtaacgatcattggcagacgataacgtgagtacatttcacggattgttgcccggaatcccattggatcaatttcccatccaaattcagtagttggtaaattaggatttttaaatccacgatagaatccggcttcaccacgagcagtttgctgatcagctccaggatccattgtttcagttccatcactagcttcacaggtagcagtattgtaatagttgaaaccaataaaatcaggatgtccatttttcaatgcttcagcatctccaggtgcaaatgttgggcaggcatcatgttcttctaagtaagcccaaactaaattattatatacaccgtaaaccgccatatccaaatataaccagtttcttatagcattatagttttgtgctgctagaacatcttcaggtttacaagaagcaggataaactaatgaaatatttggtgcaggtccgatttttgctccaggaatcatttcgtggcataatgccattgctttagcttgtgctaccagcatatgatggttttgctgatagatttctttgatttcgtttgtgcatccttccggcaagtgtaatgtaccaattaccggtccaactaaagtcagcatattttgttcgttgatcgttagccaatatttaacacgatcaccataattttcatacataacttttgcaaagtttacaaaccagtcaaccgattctggattaccccagcttcctctttcatctaaagcagccggcatatcaaaatggaacattgttaccaatggttcaataccgtattttaaacattcattaataacattattataatattcaattccttttggattgacttcaccagttccattaggtaaaattcttgtccaagcgatagagaaacgataagtcttgaatcccatttctgccatcaatgcaatatcttctttataacgatgatattgatcagcacacacatcaagttctgaagttccttcaggtacttttttgacatcctgacaagatggtccttttccatcgattaagttagctccttctacttgataagcagatgttgaagctccccataaaaaatcacttgggaatggttttagttttttgtgtaacattttatttcctccttctggcaatatatgtaccgaaaggtaaatccttagtaactgcctgtccgtcttttccatcaatatttgctgtagttacaacatcatatgtttctgcactgtcccatccgttttcagtcacatcattctttaatttgatagtaaattctgcatcattcaaaggtgtagtattgccttcctgatccagagcaactttttcgatttcaatatgatgtttttttacctcgtctttaacaacagggaagttacctgcaacgactttagcaacccctccactgccatcttgttttatttgagtcaaataaacaccattatcaatattctctgtattaccgttattatcagacagtatagctccatctaataaataaccatcaggtgcttttgtttcctgaatggtcatagtacctattggtaatgttgggtttggattgttttctgtataataaaaatcatcaccagatactttatattcatttctcaatgtagcaatgtacttagtaacaataccattactaatagcctttgtcttcaatacccatgttctagtagctttttcaggcaaatcagatactttgccatataatgcattataatattttaccgtaaattctgctccttctaacgaggcgttaccctgaggatttgactccccactatccatatctgccttttttatttcaatagatgcagggtcgttggccggctgttcaactaaacatcctataccatttagggcagtagtctgtcctgcattaatagttacagatgtatgttcaggattaagttcgaatcccggtgatgcttttgtttcaacaagtgtataattccctgcattgatacctgaaacacttgcattgccgtttacatcagtgattagtgttgcaactgtattcccacttccgtctctcaactgatattctgcaccagctaatgaatagcagtcatttccagctgtcagttcaggatttccatttactttagtaatattcaaatcacctttttttggttttattttgaatttcgcaatgcctgctccagactgactgtttacacgtttggtcaaaaatccaacaacgatttcgtcgcctgttttatcaagtacacgaacattgatcaattcatccttccattcccctcctttaccggtatccggattagaaagatgtgtacactgtaatcgtaaccatgcatcaagctgcgttgcgcctgttacattttctgctgtccagttccagaaactgttatgcgatatacctgtcaccgtatcgacaccaccctgaatccagattcctaaatacattgcagtattctgataatacagtttattgtagtctagctgacctccgtaataaattgtgttcataagatctctttcaccggttttgctcctgcctgagccagccctcttgttaatccggctccatcacctgctacatacagatcatctatttcacattcaaacccttctcttacctttggccgcgctgaatagaatttcgcttccactccatacagcaacgtatgctcattcgctatccccggtgttacattatccagtgcctcaatcatctcgataattgatttcatcgtgttgtacggtaataccagccccagatctcccggtaccgcctctgctaaggtcggctctgtatacccttctttcaaacgcttgtaagtcgttcttctccctttcttgatatctccatatctttgcaccatgactgatccgtttgacagcttgttcgccagtctgctcacctcatgtgcaaattcattcggttcattgaacggctcgctgaaggtatgggataccagcagcgcaaagttggtattcttgctccccagcttcggatcatgataggcatgtccgttcgccagcatcgtcccgctgtgattctctattactacatgccctgacggatttgaacagaatgttcttacttttgttccgacacttgtattatagacaaatttaccttcatacagattgctgttgatctcttccattacgatattgctggtctctacccgcactcctatatcgacctgattattataaagctccagtccatgctgtttcagtacttttgtcagccaggcagaaccgtctcgtcccggtgccagtacgatcttcttcgctttgatgacctcatcattttccagaactaccccgacagcatgtccgtcttcaaccagcacttcctttacagctgttctaaatgccatatcaatatgttctttcagttccgttgacatttctgtcatgatccgcagattctcttctgttcctaaatgtcttaccttggcccgcagcagttttaatcctactgcatagcctcgatgttcaatttctttgaccttgtcagtcgtaggatccgttatttctctggttgctccgtgttttaaataaagattgtcaacatagttgattacatcttcaacctcattggttgaaagatagtcagtcagccagccgccaaattcactggtaatattgaatttaccgtcagaataggcaccggcaccgccaaatccggctgtaatcgaacaggcaggaagacagcccggttcattgttcctgatgattggacaggacttgatcttcttttccttgattggacagtgacgtttcataacatcctgacctttatctataagcaatacgttcaattccggctgtttcaaatacagttcatagcaggccatgattcctgctggtcccgctccaacaaccacaacatcataattatttttcataaacagaggagaaaaagaaaatggaaaagaaatattcagttgttattgctggtggtggaagtactttcacacctgggatttgtttattattgttagatcatatggatcgttttccaattagaaaaattaaattttatgataattttgcggaacgtcaagaaaccatcgctaaagcctgtgaaatttatttaaaagaaaatgcaccagaagttgagttcgcttatactactgatccagaagaagcttttactgatgttgacttcgttatgtgtcatattcgtgttggattatatgcaatgcgtgaaaaagatgaaaagattccaatgaaatataatgttgttggtcaggagacttgtggtcctggtggaattgcttatggcatgcgttctattggcggggttattgaaattctggattacatggaaaaatattctccaaatgcctggatgttaaattattctaatccagctgccatcgtagctgaagcaacaagaagattacgtcctgattctaagatcttaaatatctgtgacatgccaatcgatcttgaagaaaagatggctaacatggtagggttaaagtcacgtaaagagatgtctgttggatattatggattaaaccactttggatggtggcataaaattgaagataaagacggtaatgacttaatgccggaaatcaagaagcatatggcagctaatggttttgcagatgcactgtcaggaacgaatcagcacgtggaacaaagctggattgaaacattcgcaaaagcaaaagatgtttatgcattagatccagaaacaatcccaaacacatatttaaaatattatttatatcctgattatgtagtagaacatactaatccggaacatacacgggcaaatgaagtaatggagcatcgagaaaagaatatctttacagcttgtagaaagatcatcgaaaaaggaacagctgtagacggagggtttgaaccagatgcgcatgctgaatatattgttgacttagcttgtgcaattgctaaaaacactaaagaaaaaatgttattgatcgtaccgaatgaaggagcagtagaaaactttgaccgtacggcaatggtagagattccatgtatcgtaggaagcagcggatatgaaagaatctgtcagggatcaattccacaattccaaaagggattaatggaacaacaagtatcagtagagaaattagtagtagatgcatggataacaggaagctatcaaaaattatggcaagcaatcacattatcaaaaacagtaccaagtgcaagagtagcgaaattaatcttagatgatttaattgaagcgaataaagatttctggcctgaattgaaataagatgttaaaactatttaaaaagaaaagtatttcttggaaaattgacaattaatttatcattttcaataatatttaaattataaccaaattttttaatagttttacttattgtttttaatttatatttactagctaaagttaatacacatgaataatataatacgtaatagattctttctcttaatcttttataattagtagctaatttataataatttaagatacctctacctaacgctttataattattaataattgttctaggttcttcatatagtcatctacctactcttgtaggcactcctattctaccatttttattatgcttacaatatccattagtagctaatttattgataatatctctaattggtgcattaataataggtctagttgtatttctacttctaataagtttacctctaattagtttagtaactgtaggtattctttttaaaggtgtaattgaaatattataacctaaaaatcttgctggtagttcagttgcacaagtaattaaagttttttcttcatttatatttaaacctaatgaatttaaaaaattgtttaaatctcttttgattattttacaatcattttttgaacctaataccccaattaaaatatcatctgcatatctaacgtattttattctcttgaaattaggatcattataaataaatagtgggcctttagctctttctttatgtaattttaatcttgtcgaaaatattttagcttttgcaattattcttgataattttttatatgtaggatgttgttttttaactttacctttattatataaattaatataatcttctaatcaattatctaccaatgttattacaatattacataagataggactaattaatgatccttgaggtaaacctaatataggtttatgataagttcctttctcatcaatataaccagctcttaataatttatatactaaatcaataaaacctttatctgaaatatatctttttaattctttaataattaaatcatgagaaattgtatcaaaacatttttttaagtctacttcaataaatcaattacttccaccaaatatatttctaacttctcaaattgctgtttgacaacttatattctttctaaaaccatgtgaatgtgttgatatctttttatcaaaaattgtatctaaaattattcttataacttcttgtacaattttatctcttggattacctacacttaaaggtcttataccacctttaggtttaggtatattaactattctcatgggtttaaatttgaatttacctgttcctaattcatttgataatttatttaaatatattatatttataccatctaatgtttctaatgttgtacctggagttatattaccaggtttactcttaattcctggcgatatatgtaccaaaaggcaggtccttagtaaccgcctgtccgtcttttccatcaatatttgctgtagttacgacatcatatgcttctgcactgtcccatcctttttcctcaacttcactctttaatttaatagaaaattcagcaccgtttaatggtgttttgttaccttcctgatccagagcaactttttcgatttcaatatggtgtttttttacctcatctttaacaatggggaagttacctgcaacaacagacgtagtatttccattttgcttaatctgtgtaagataaacaccattgtcaatactttcactacttccagtgctgtctatcagagttgcaccctccaataaatagccatcaggtgcttttgtttcctgtattgtcattgtacctattggtaatgttgtaaaaccatctattttaaataattcatcgcttttctcattaactaaatacttatctcccaatctagccacactgtctccagccgtatttcttattgttttcaatacccatgttctagtagctttttcaggcaagtcagatactttatcataaagatcgttgtagtatttaactgtaaactccgctccttcaagagaagcatttccctgtgatgctgattcgctgttatcagcatccattttagtaatttgtattgcaacagggtcattggctggctgttcaactaaacatcccacaccgttcagtgtagtagtctgacctgcgttgatagtaacagatgtatgctctgtattaagttcgaagcccggtgatgcttttgtttcaacaagtgtataattacctgcattgatacctgaaacactcgcattgccgtttacatcagtgattagtgttgcaactgtattcccgcttccgtctctcaactgatattctgcaccagctaatgaatagcagtcgtttccagctgtcagttctggatttccatttactttagtaatattcaaatcacctttttttggttttattttgaatttcgcaatacctgctccagactgactgtttactcgtttagtcaagaatcctacaacgatttcatctccagttttatcaagcacacgaacattgataagttcatctttccattcgacacctttaccagtatcagggttagaaagatgtgtacactgtaatcttaaccatgcatcaagctgtgttgcgcctgttacattttccgctgtccagttccaaaaactgttatgccatataccagtcgttgtatcgacaccgccctgaatccagattcctaaatacatagcggtattctgataatacagtttattgtagtctagctgacctccgtaataaattgtgttcataagatctctttcaccggttttcttactttagagtataaataaaaaggaggatttaaatgctgttgataaattcaatagtttgaatcctctaattttatgattgtttaaaccaagtaggaaccattattctctgcactcttttgtttctttgtcttctctaatacctttgcaaacaggttgacgcataccttctttgttagaaggcatatattgtactatacatactaaattaggttctatccaaactgcattatcatttcctttgggtagatcacaattaaatggatgatgctttatgatagtgtaattgtattgatctaatgttcttatactcgcacccaaagtgacatgtccatagtattttaaattattacttgaatcgtatttacctaatataaaacttgtcatattgttgtctttttgaatatatccgcagagaacgaaatcatcatcaaccagatatttaaatttaatccagtcagttgaacgcttttcaaagaaatatttgctaccttttcgtttagcaactactccttccagttcttttgatttgacaatattaaataactctataccagtattttctataacttttgatatagatatacgattatcttcattaattaatcgtggcaatttgtttattctttcttctattggtatatcgataagtaagtcattgtcaagatatattaaatcatagacaacaaaggtagcaggatacttttcggataagagttttattttaaaaaagtcagttataactgtacgcttttgaacttcgtaaaagtcaggtttaccgtttttaaggacaatgatctctccatcaagaatgcattgtccattaacattggaaaaaatattagaaagttcaggaaactgattaatcagttctttgttacgcttatttcttaaatcaacactttttctatcaatatatgcaagacatctgattccatcaaactttaattcaaataaatactctggtgagttgaacggctcagattgattagcaattagcattggtcttgctaaacgtttatcaaaaatgtcattcatagttacgatgccatgttatttgatgcttgtgtgttagctagatcaatagactgctgcagtgcagacattaaatcaattacactgttaggctgactgtcatcagcaactactacttcctgaccgtttattttagtctgtatagcatcatgcaatttagcttgctacgattgcaattgcttgagatacagcacccatgatattagctcctgtagttaagaaaccatgtaagataggtggtgttgtccaaggtgtattgattacagcttttggacagaatccaattacagttaagatataacctactgctaaagtagcaattggtgctaatacaaatggaatacctaagattgggtttaataccattgggataccaaatgtaactgtttcattgatgttgaataaacctggtactaatgagatacctgcgattgtacggttatcttcacgttttgagaaaatcatgattgcgattactaaaccgattgtaaccccagaaccaccaaattcaccgaacatttgtaaccatgccattgcgaaaatgtgtaattcatcgctttttgcatcatttgttttagagaatgtttcaatattttctaacattaatggtgtaaataatgcttcttttactgcagataacatgttgttaccatgaatacctactaaccagaataacatgataatgatgtaaatgataattacaccaggaactgtagcaccgatagcacctaaaggtccttggatgtaagttgaaattacgtcatttaaatataatccagtagctaattcacatccacgtccaattaacgcaatgattgctaaagtaattacagctggaattaaaacttcgaatgcacgagcaacacctggaggtactgtttcaggcatttttaattttaacccttctactttacgtaatgcacagaagatttctactgaaacaaccccaacgatcatccctgtaaataaacctgttgctcctaaagcaccaccagcaacacctgtaaatgtttgtaatgctccatcagctgttaatgataaagtttgtttagcagtatctactaatgcatagttagcccatccactttgagttactgataaccaacaagcaagtcctaataaacctgcgaagtatccagtttcaccatttgattccccgatttcttgagcgataccaaaagtgattccaactgtgatacaagaaattgttgcgaattgcattgctgcaaacgctgggttaattacttctaaagccatgataggttcccagaacatacctaaccctgaatctgcattaactaatacgttacaccataaaaccccgatcgcacctgcgatagtcaaaggcatgaatgtttggaacggtcattgttatcttatactctccaattgctggataatctttaccgtcctcatatttaaaattagattttatacttaatccattttttaatatttttttatcttcatcatccataccttctgtattcaataatttcatgccattgatagaatatttctcaccatattctagtttaatagctttactatcacttagaacaaaatcgggtaaattagctcttgctaaagcatatatacccagtatactagctaagattactgcagctgaagtaattcctgcaataatatgtttttctcctgtatctaaataatttaaatataattttctaatcttcattttagtttctccctccaaataaaaaactggtccacatagtgaaacagttttttatatctttgatttttcatttctagtatttcgaatttcactattatctaacccacataaataatcaaggctaactttatataattttgccaactgtatcagtttatctactggtggtaactgttcattaagctcatatgctgcaattgatgaacgctttatacctgtcaatattgcaacttcattttgggtcaaattttgttcaattctcaactctcttaatttctttccaattttcataatctcccacccatatataatttaccaaaaattgtgtcattttaggcgacatccttgcaatttgtcattttttttagtaggtcaaatgacctaccatataactcttttttggcgactgcctttgccttaaattgtgatcgtatttcacgatcacttgaatatgcggttttttgcttacaattgggagtgcataggaaaacagaaaaggaaattttattttcttttttgtttgacttgccgagcaagtcggacagcaaaaaatgtttttgtcaataatgactgtgcagcagtcaagataaaataaatttttattgtggccttcaggtccagtaaaaaattatttttcgcttattgacaaataacaagctgttaataataaaactctctcctacagatttttaatgtagaccattttgttaatagaaactttattcttgtaatcatcactgtgaacctcaccacctaatttactttgtaaatatagatggtgcttccgacctcagcttcagattataaatctaaaattaaaagaccctataaaaatcgatgtaaaagcaacttatggagctgacaacagattaaattatgttaagggcgatggcgcaactgcaaagacattacagaaattagcagcaacagcaagttttaaagaattttacacaggtgcatatagtcaatatgacaaaacactttcaactgatgtagatacaggtacacttaatatcaaggttgtaaacaaagttggatctaaacttcctgcaacaggtagtatggccactttattattagttgtaacgggtactgcggtgatggtaactgtacttatcagaagaagaaaaaatgaaaaagatgagaattctcaaatttcttaaaaaagatattttaatttttataacaggactggctcttgtgagctaccctgttatttctaattatatagagtccagagaacaggcaggtcagatcgacacatataacagttctgtcaatgagttgagcagtgcaaataaacaaacaatgctgaatgaagctcatgaatggaatgataacctgtattcaaaacaaaagggactgtcagagaattcagggttagaatatgaaaatgttttaaattttggaaatggtgtaataggaactgtagaaattccaaagataaagctaaatatacctgtttatcatggtacagacagtgatgtattaaacgtgggagctggccatttagaggacagttctttgcctgtaggtggtaacaatacacacacggttttaacaggtcacagaggactaccatcaagtaaactttttactcgattagacgaacttaaaaagggtgatcttttttttattaaagtaattgatgaaacattggcttacaaaataaataaaatcgagatagtactgcctgataaggtcagttattcaattatagataatcaggatttagcaacactgattacctgtactccttatgggctaaatacccacaggcttgtaataacaggtaaaagagttccgtatgaagaaaaggaaaagaaatcaattaaaagcagtatgccgtcattaagggaaattattttctatgttattcctgttctgttttcagtggcaggcatactattttttagaaaacgttaaaagaccctataaaaatcgatgtaaaagcaacttatggagctgacaacagattaaattatgttaagggcgatggtgcaacagcaaagacattacagaaattagcagcaacagcaagttttaaagaattttacacaggcgcatatagtcaatatgacaaaacactatcaactgatgtagatacaggtacatttaatatcaaggttgtaaacaaagttggatctaaacttcctgcaacaggtagtatggccactttattattagttgcaacgggtactgcggtgatggtaactgtacttgtcagaagaagaaaaaatgaaaaaaatgagaattctcaaatttcttaaaaaagatattttaatttttataacaggactgactcttgtgagctatcctgttatttctaattatatagagtccagagaacaggcagatcagatcgatacatataacagttctgtcagtgagttaagcagagcaaataaacagttaatgctgaacgaagctcatgaatggaatgataacctgtattcaaaagaaaagggactgccagaggattcagggttagaatatgaaaatgttttagatcttggaaatggtgtaataggaactgtagaaattccaaaaataaaggtaaatatgcctgtctatcatggtacagacagtgatgtattaaatgtgggagctggccatatagaggacagttctttgcctgtaggtggtaacaatacccacactgttttaactggccatagaggcttgccgtcaagcaaactttttactcgattagacgaacttaaaaagggtgatcttttttttattaaagtaatcgatgaaactttagcatataaaataaataaaatagaggtaatactgcctgataaggtcagttattcaattatagataatcaggatttagcgacacttattacctgtactccttatgggctaaatacccacaggcttgtaataacaggtaaaagagttccatataagaaaaaggaaaagaaatcaattaaaagcagtattccgtcattaagggaaattattttctatgttattcctgttctgttttcagtggcaggcatactattttttagaaaacgtgatgtgtacccagttttctggacacgtttaaatttagttttaaaaaaattatgccatggatgctaatctgtacaaaacaggtggcatccattttgttttttctgtattcttttattgcagtagaaaactcttaaaatgaattgtattcattttcatacccataatagacttcattttttaatcggccaaagaaagtttccattaccgaattatcataacagtttccttttctagacgttgattgtattatactgtgttcttttaatgaattgatataatgagcatgttgatatttccatccctgatctgagtggaaaatcaatccttcaaggatgggaaacttttcatatgcctgagtcagcatatttgtaatttgtttaagattaggatgcggtgataaatcataggaaataatctcatttgtaaacctatctaatattggagaaatataacattttcctcatgcaaaattgaattgagatacatcagtagtccatttttgtaatggtctactcgcattaaaattctattaataatattatctgctacattccctttataagaatggtatctctctttaggacgtttacctaataatcccatattatgcataagtcgttgcactctcttatgatttaccagataaccgcgatttagaagctctctatgaactcgacgaattccatagcgtccccttattttgatcaaagatttcttttatcagtttcatcatctcatgcctttagaagatgctttaatcgatatcctttttcacgaatttctttaacgattgctgctcttaaacgtattagttcttctttctcaggaggagtaagttcacttgatattatagattttttcagaggctgctccttactatgtcgtcccttctttaaatcgagaccattatatccatatattttatatcgttttacccagtttgacaattgactgtgattaatattagcacttattgcaacactttttttgagattctccagctagaaccctggcaactaaagcgtatctttcttccacagtatactcagtctcaggatatagttactgcaaaagaggaatctgatgctgaagcatctgaaaataatcttgatccagtaactgctgaatatattaaaaataatcttgatactgcatacacatcattaaatatgatgcgtttagatcaggtattagttgtaaaaaacactttagttgaagcggagggaatcgctgaaaatgaaacaatcgacagtttctttttaagagaagatactggtgatctgtttataacaactatcccttccactgtcgcattatataacctcgatataaacagtaattattatgttggtctgggaaatacaatgctgaatgacagtactgctgaagtaaaggatcagatctttgcaataaacaataacaatgccgaagttgtcaatgacagatgtcattacgatgcagaaacaggtttagtttatatttcaaaagatctgtttggaaacactgccggtaatgttcaggtacagtttctacaggctgtatcacagtcaaccgcaaaactgtcatctgaagttaattatactacaactgacagcagaacggtaaaagaaggaagcagaaatgttgacagttttgattttgaaacaaatgtcaaaactgagaaggatttagataaaactgaattaacagtttctgttaacggtttaccgacaagcaactacagttatgactctgaaagtggtgtaataacaattccgcagtcatctactgcggtacagtcagtaaacgttgatgttgataaaaaatcaccgatagcaaaactggcagataaatttctaaatatcactaatgttgaagccttttcaatgggtgaaatggggtgtgcaggaactgtagatgttccagacggtgtaggtatcgggtggagcggtcagatatctttgtataaggcatatgcttctgactggaaaaatgcaacactgcctgtttatggtttaacaaccggtgaaagagatcttatgaacacaatttattacggaggtcagctagactacaataaactgtattatcagaatac
